United States Patent 11,395,838 (METHODS FOR ENHANCING IMMUNE CHECKPOINT BLOCKADE THERAPY BY MODULATING THE MICROBIOME) - sequence listing, part 2

SEQ ID NO: 2172 - DNA, 3345 bp, Unknown
  Artificiall/Consensus sequence
gccagcgactatgccgcgctccggtattcctcgggcgcaacgacggtcgtgacggccaagaaggccaccggctccaccacgctgaccctgacggctaagaccacgaccggcacgggcagagacaccgtgacctattataactactggaccgtgaccatcacggcctggggcatcacgctgtctccggatcccatgaatctggtcggcggcaagaccggtacgctgaccgccacggtcaccggcccggctgcttctccagtcggcacggacggcggcctgggcaatgcgaaggtcactttcaaaagcggtgacgagaatgttgttacggtaggctcgtcgggtgagcaggaggtcaacagcagaagtggcaaggccacaacaaatgtcacggcgaaggataaaaccgacgcgactcttgtgtcggcaacgctcaagtatacccactactatacggataataatgataatcagaagagttcgccgctcaccatgaccgcggacgtcggcgtctatgtgacgaagtcgagcgagcagacgctctccatcctcaatggctccaccgatgtgacgaataagacgatcagcgctacgacaagcaccaagagcttcacgctgacggcttctctgaacggcagcaccacaggcagctactcctgggagagcgacaatacatctgtcgcgaccatcggcagaagcaccggcgctgtggtcatcaagggcgagggcagcacggaaattacggtcacttcgcttgcaaacagcagtctgacggccacctgcacgatcaacgtttccaacgagacgatcacgatcgacagcattacatacagcgacagcacgatcaatgatctggaaacgaagaatctgaaattcagcgatgaagatcctgctattacgaattatactgtaaacaccattggcttggtcgcgaaccttagcgatccggcgggcgatggcaatgttgaatggaaaatcgacaagccaagctttgcaaaattcgtcgttggttctagtgaggtaaatacggtaaagggaactaccgaagtaacgctgaaagccgaatatccgggcgaggtcaaggtcaccgcgacgatcaccaacgcaaacggcaagaaagactccaagagcatgaccatccagatctggacggccaaggcctataacaagcaggtcgttccgtccccggtcttcacggccagcacggcgctgaaggtcgtacagcagctcgcaggcgagactgcggtgatcacgcttgaaagcaccggcagaaccgaggatcgtccgcttaagaacatcaagtctgtcacgaccggcggccagctgcagatcaccggcgagatcaatggcattgatgacaaaaacttcatcgtttattatccaaagactcccgcgaccggcaagttcacgctcaagagcgcaagcgcgagcggtatcgagttctacacgcagcccgcttccgcgacctataaggtcaacgccgacttcacgggcgagaacctgtatgtcgatgtcggcacgacgcagtccggctacacgctttccagcgtgaagtggtacaacgcggctgacaccaccaccaccctgcagtcggagaactgcggcaccaatgtgaccagaacgacctccacgctcagcctgaagacgctggtcgacaagggcttcatcaccggccccggcgactacaccttccagtgccttgtcacggccacgagcgggacccagactgtgaccggcatcagcaacgtggcgaccatcaccatcagcggcgactacttcgttgagatcaccgcggccaagaccgaggtcagtgtcggcgataccttcacggtctccggcgtggcccagacctataacccgtcctccaagaagtatgtcgacgtctccgcagcgcacaacctcacctggacgctgagcgattcctcgctcgctaccctcagcaagaccacctccgccaagggcgcgaccatcaacgtcacggccacggccggcggcaagctcgtcctgacggccaagaccaccatcaacggcaaggactatgagggcaccaagaccatcaccatctcgaccccgaaggcggacgacgtccgcgtgacgctgggcgatgacgatacctacgtcatgctcgacggcagcaagatctccgacgcagtcaaggcggcgaccaagtccacacccagtaccttcatgttcaagcagccgtcctacggcacggtctatacctcgagcagcctctccagcgccatcagcacgaccacgaagtattccgcttccgaggtcagcaagatggccttcaagccgacccggaccgccggcagctacacgatcgagtacaccgcttacgtctccaacggcgagcttgccaccggcaagatcatcgtcatgaccagcagcggtactgtgacctatcacatctccgcaaacgaagcgcaggccatgcaggagagcgatttccgcaacatctactccggcacgctgaagtctgtccgcttcggctccaccggcgattcccgcggctccctctataagggcagcacgaccggctccggcaagatcgacaccacgacgtcctacttcatttccagtcaggcgtctacgggcgcgagcctgctgtcgaacgtcaacttcatcgccggctccagcgcgtccaagtactccgtgaccatcccgttcacggcctccggtacggccggcgatgtggagggcagcctcattgtctacgtcaatgacacgcactccatctactccaccggcgcaacgttcaagtccatgtccatcgcggacgagctggcgcccgaatccggcgcgaacagcgcgtacctgaccatcaccggcgtcaccggcggcaagctctacacgcagtataccaacatcaccagctgcaccgagctgagcagcaaggagtacaacagcacgaagttctacttctccggctccaactccgttgataacctctacgtcctgccgaaggcagacgcgactgcggtcgtcgtcagctacaccatcaacggctcgactaagggctccgtcaacttcaaggttgtccagcagacggcctcccagaagttcaaggacgtcagcggctcgaccaagtgggcctccaactccgtcgatttcatgtccggcaacggccttgtcaacggtatcagcaccaaggacccgacggtctttggcccgaaccagagcatgacccgtgccatgttggtgaccatcctctatcgtgcggccggtcagccgtccgttgcaggcatcaccaacaagttcaccgacaacaaggaaaaacagtactactacaacgcagtcctgtgggcctccaacaacggtatcgtcaacggcgcgaccgccaag

SEQ ID NO: 2173 - DNA, 1167 bp, Unknown
  Artificiall/Consensus sequence
atgaaacgcgtctttgtaattgtactcgattcctgcggcatcggctttgagccggacgccgcggacttcggcgacgtcggggccaacacgctgcacacgtgcagcctgtcgccggaatttcatatggacaatctgatctccatgggccttggcagcatcgacggtgtggactatctgccgaagacggacaagcctgccgcggcgctcgcgcgattgcaggaactctcgcgcggcaaggacacgaccatcggccattgggagatcgcgggcatcgtctcgccgcagccgctgccgacattcccgggcggcttcccggaggagatcctgaagcccttccgcgagcagaccgggcgcggtgttttgtgcaacaagccgtattccggcacggaggtcatcaaggactatggccgcgagcatgtggcgaccggcgatctgatcgtctatacctccgccgattccgtgttccagatcgcggcacatgaatcggtcgttccgccggagcagctgtatgcatactgccgcatcgcgcgcaagctcctgcgcggcaaatatggcgtcggtcgcgtcattgcccgcccgttcgagggcgaatggccgttcagccgcacgccgcggcggcacgatttctcgctggagccgccggagaagacgatgctggacgccgtcaaggacgcgggacaggacgtgatcgccgtcggcaagatccacgatatcttcgcaggcgagggcatgacggagttcacctacacgaccggcaacaccgacggcctgcagaaaacactcgcgctggcggaccgggagttccacggcctgtgcttcgtcaatctggtcgattttgacatgctctatggccatcgccgcaacccggacgggtatgcaaaggcgctgcatgagtttgacgactggctgcccggctttttgcagaagctcggggacgaggactgcgtgatcatcaccgccgaccacggctgcgaccccggttatctgaagcacaccgaccacacgcgcgagtatatcccgatgatcgcgctgggcaaaaagatccgcccggtcaatctcggcacgcgggccggcttctgcgacatcgccgcgacggtgacgcagcttctgggtgtcccgttccagacgccgggcaagagctttgcagatgagatcgtaactgcgtga

SEQ ID NO: 2174 - DNA, 1125 bp, Unknown
  Artificiall/Consensus sequence
atggatacgacatttgaatcccgatttttgtccgcgcgccgcgcagtgatcgctgcccggttcgcgtcgctcaacgatatgcagcgcgaaggcgtcatgacgacacaggggccgcttcttctgctggccggcgccggaagcggcaagacaactgtacttatcaaccgcatcgcgaacctcattgccttcggcgaaggctccgattcggaagaaattccggatttcatcacggaggaggacgttacatacctcgagacctatctgcagacacgcgatcccgccatgcagatgcaggccgagcggctttgcgcgctgcgcccggccgcgccgtggtcgatccttgccatcacgtttacgaacaaggcggccaacgagctgaaatccagattgcaggcgctgttgggcgactatgccatggacgtgtgggccatgacgttccacgcggcctgctgccgcatcctgcgccgggaaatcgaccggctggacggctacaccggccggttcacgatctatgattcgagcgattccgagcgcgtgatgaaggacattctgaaggactttgatctggatgaaaaggcgctgccgccgcggctggcgctctcgctcatcagcaaggccaaggacaagcggcaggacccggaggccttcggcaggagcgcagataaatccggcgatttccgcatggagcgcatcgcacaggtttacgcggaatacgaaaagcgcctgcacgaagccaacgcgctggactttgacgatatcatcctcaaaaccgtggagctgctggaagcctatgaggatgtgcgcacctattaccagaagaaattccactacgtcatgatcgacgaatatcaggacacgaaccagctgcagtaccgcctgacggcgctgctggccgggggctacgaaaatatctgcgtcgtcggcgacgatgaccagtccatctacaaattccgcggcgcaacgatcgagaacattctttcctttgaaaagcagttcaagggcgcgcgcgtcatccggctcgagcagaactaccgctcgacgcaggcaatcctgaacgccgcgaacgcggtcatttcccataaccgcggccgcaagggcaaaaagctctggaccgagaacgccgcg

SEQ ID NO: 2175 - DNA, 954 bp, Unknown
  Artificiall/Consensus sequence
atgaaactcgaaaaagcaacgcagccgaccatgtactttatcggcgtcacgaccggcggctcttccatcatgaaggtcttcccggagtgggccaaggcgcttggcttcaaggatgccgtgatgaagggcatcgacatcgccatccatgaaaagcccgaggtctaccgtgaagtcgtcgacttcatcaagcatgacccgctttccctcggtgcgctcgtcacgacccataagatcgatatctacaatgccgcccacgacatgttcgacgtggaaggcacctacgccaagcagttcggcgagatctcctcgatctacaaagaggacggcaagctctgctgcgacgcaaaggaccccatcacctgcggtatggccatggaagagttcgttccggccggttactggaaagagcatccggaagcgggcgtgtttatcatgggcgccggcggcagctgcatctccatgtgctcgtactacatgcgcaactacaacaaggaaaacagcccggccaagatcgtcgttgccaaccgcagcctgcccagactggaagagtgcgagaagatcaacaacgagttctatccgaacaccatccccgctgagtattatctgacgccggaacccggccagaacgacgctgagatggccaagatgggcaaaggctcgctcgtcatcaacgcgaccggcctcggcaaggaccgcccgggttccccgctgaccgacgcagctgttttcccggaaaatgcactggtttgggagctgaactaccgcggcgagcgtctgttcatgcatcaggcagaggcacaggaaaagacccgcggcgtcaaggtgatcgacggctggatgtacttcatctacggctggacccaggtcatcgctgacgtgttccacacggagatcctcggcgagcgtctgaaggaaatggaccgcatcgctgcaaaattcaacaaccgcgcataa

SEQ ID NO: 2176 - DNA, 2601 bp, Unknown
  Artificiall/Consensus sequence
atgctgtcgacacaagatatagaaagcatcatcgattctggacatgaaaaggagtatcacatgaaaatcaaacgtatcaccgcccttctgctggcagcactgctcatgcttgggctgttcgccggctgctcgaaggacggctcgaaggacacgaacaagcccgattccagcggttctctcatcgatcaggctcagcgttccgacaccagcgccaaatacagctatctggccgactatctcgacctgaccatgccggtcgagctgcagtacgtcaactccatgtgcgcggcgggcaccacgctctacatgaccgccgccaaacaaggcgaagagcacacctataccgaccccgattccggcagcagctggtcgtattacgacacggagctgaccatcctgtccattgaccccgataccggcatgtgcgcggagcttccgaacctgcagctgcccacgggccccgaggactgcgagggcagcgtcgactgctacagcatggcaggtgcagaggacggcacgctctggatgctcatcaatgtctacgcgacgaagtttgacctccctgcggattttgaccccgagacggatgacaagtggaactatccctcgacggacatccccggctcgtatctcatgcacattgccgccgacggcagcacgctcgccaacatcgatctgctggctgcggatgacagtgccctcaaagaggacggcatgagcagcaacatctcctccttcgcggtcgacgccgccggcaatctctatgccagcgattacacgaatgtttatgtgctggacgccgaaggcaagctgctcttcaagctcgacggcagcgaatacagcggcagtctctgccagctgaaagccgatcaggtcggcattctgtggtataactacgtcgacgacactgccgccaatgccggcagcgacgaaagcggtcagtattttatccccgtcgatctcgaggcaaaggcgtggggcgaaaagcagaagatgcccgtcaacgcgtggacgatctatcccggcgacgacacctatgacttctattacgacaataacagcaacatctacggctattccttcgccaccgacagcaaggataagctggtcgactggatggcctgcgatgtggacacgaacaacatgtataacaccgccatcctctccgacggccgcgtcgcgggcataacacaggagtataccggcgataccacgacctatcagctcatcgtcctgcatcgcgtcgacgcatccgagatcaaggaaaagaccgtcctgacgctcgcgtgcatgggccttgactggaacctgcgcagccagatcgttgaatacaacaagtcgaacgaccagtaccgcatcaacgtcatcgactacagcgaatacgccaccgacgacgactataacgccggcgtcaccaagctcaccaccgagatcatcagcggcagcatcccggatctcttcctcaccagcagcctgcccgtcgacaaatacgccgccaagggcgtcatcgccgacctctataccttcatggatcaggacagcaccatgacccgcgactactttgtcccgcaggtcctgaaggcgctggagaaggacggtaagctctatgagctgcccaacggcttctccgtgcggacggcctttgccctgtcctccatcgcggagcagtatgacatctggaacgtcgcggccgtgcaggacgccatgacgcagctgcaggacggcgcgaccgttttctccgacggctggacaaaggcgcaggtgctcaataactgcctgtcccgcaacctcagtacgttcgtcgactggacgacgggcaagtgctcgttcgattccgaagcgttccagcagctgctggccttctgcaactccttcccggacgaaaccagcagtgatgacgcaattgcctatggttccgcagataccgctgtcgccatcgacgcgggcgaatgggaatccgatgttgcccgcatcgccagcggcaagcagctgatggccgtcacctccatctatgacttctcggattacatctataacacctactccctcaacggcaagatcaccttcaccggctatcccaccgaggacggcaagtccggcaattcgttctatatcaactgcccgctcgccatctcctccacgaccaagtatccggacgcggcatgggacttcgtcaaggccatgatccagaagtccaacgaggaagccgagtacatgtacgccttccctatcagccaggccaaattcgacgaaaagctgaccgccgccatgacggaggaatatcagctcgacgagaacggcgagcaggtcgactgggacggcgacggccagcccgatctcgtctccaagggcggatatgaagtcctcggcggcgaccccaacgattacaactggcagccggtctacgccctgacgcaggccgacatcgaccagatcctcgcgctcatcaacgcaaccaccggcgtctatgactacgacacggagatcctcgacatcgtctcccaggaggtcagcgcctacttcgccggcgacaaggacgtcaaggccaccgccgacatgatccagagccgcgtcaacctgtacgtacaggagcagcggtaa

SEQ ID NO: 2177 - DNA, 1629 bp, Unknown
  Artificiall/Consensus sequence
agcctcaccactatctccggcctggctgctatgatgtttatgcagttcaaaatcggatttgatatgggcatcgtactgatcaaggcaatcctgttcagtatgctctctgtcttcacattgatgccaggactattgatgctcttttctgaggcgatggcgcgaacccgtcaccgcagctttatccccaagatcgacgcctggggcaagctcacgttaaagttgcgctatgtgggagctcccctatttgcagtagcccttgtcgtgggtttttttctctccaaccagtgcccctatgtatacggctatacacaaattaaaactgcccggcagaatgaatcccaaatcgcagaggagaaggtcaaccatacctttggcgcccaaaacatcatggccctactggtgccaaaaggggattataacagtgaaaaggccctgttggcccggttggaagcccatgatcaggtagattacgccatggggctgtccaacgtagaagttatggatgggcacacattgacagatgccctaactccccggcagttttctgagatgaccgacttggactacgacctggtgtgcctgctgtacaccgcctatgcagcggaggagggcgagtacggacagatcgtagggggcatcgacggcttcgccgttcctctgatggacatgttcttctttgcctaccaaaaagtagaggatggctatgttgatttggacgaggagcagttggatacgctggaggagctcaatgcccagctctctgacgcccaggtccagcttctgggcgaaacccatacccggatgttaatcagcctggacttacctgaagagggagccgaaacctttgccttcctccagaccattcaccaggaggcagagcgaggctatgacgcagagagcgtctatctggtgggtgactccaccagcgactacgatctctccgtttcctttgccagagataatattatgatcagtgtcctgtctgttgtttttgtcatcatcgtccttctctttactttccagtccgtgggactccctcttttgctgattcttgtgatacagggcagtatctggatcaatttttcttttccaggagtaacacagaagccaatcttctttatgagctatctgatcgtcaccgccatccagatgggtgccaacattgactacgccatcgtgatctcctcctggtacagcgaatggaaagccaaactctctaaaagggaggccatcatccaggccctgaacttgtccttccccacggtattgacctccggcagcattttgtcctccgcaggctttctgattgcccgcatcaccacggaacctgcaattgtgggcatcggggagtgtctatgccgggggactctgatctccatgtttctcgtcatgttcattctgcctcaaattctgttcctaggggataaaattgtggaaaagacccggttcaacctgaaagtcccagaagtcaaccgcagtgtcagcggcacgatctatgtaaatggccgcgtccgtggccgggtgtccggggtggtagatgcacagatccagggcgtaatccacggcgacctatccgggatgctggagaccggaagctatcgtcagacagagggggatgtcgaccaatga

SEQ ID NO: 2178 - DNA, 2697 bp, Unknown
  Artificiall/Consensus sequence
atgaaatttattgaattgatcctgcgccgccccatgtctgtcatcatgctgatcctcggtgtggtggtgttcggctccttctccctgaccagtatgcccctggaatatatgccggatatggagatgcctatggagctggtaatggtcacttggcccggcgccgacgccgacagcgtggaccggctgcttacccagcccttggaggaggagtgtgaatctctgtccgatctagacagcctcaactcctattcctttgagaattacaccatgcttcagttgacctataagtatggtacagatatggacgatgcctattccgatctgaaaagcactattgacaacctgatgccctctctgccagaggactgccaggaccctatgatcatggagatcagcgcggacgccatcggcaccatgatgatctctgctaccgctccgtcaggggtcaatgtagccgacttcttggacgcagaggtcgttcctgccttggaaaatatcggcggcgtggctcaggtcgagctctctggcagtcaggacgagtatctacgtattgtattggacgaagccgctctgaagcaatatggcctcaccatctcctcagtgggctccgccatcgctgcggccgattttgacatgcccgtaggcagcgtaagcttgggcagccaggacatctccctgagcgtatatggcaatgtggacatcgatccctccttccgggacctgcccattcagactccctccggccatacagtgatgctggcggacatcaccaccttcttcaatctctacgaagacgatgccgacacagtcagccgttataacggcaatgagagcgtcatgctcaccatcaccaagcaggactccgccccaaccatggaagtgtgcaacagcgtcacggaagtgctggagcgctacagcgtggacggcgtggcttttgaagtcatttatagcgaaggagagagcattttagagaccctgggtgaagtgctcaacaccctgatcaccggcgtcatcctcaccatgctcgttctcttcctcttctttggcgacttacgcgccagcctgatcgttgggatcagtatgcccctgtctattctgctggctgtgattctgctcaacctcgccggcttccagattgatctgatgaccggctctgccctgattatcgccataggcatgatcgtagacaactccatcgttatcctggagagctgcatgagatctaaagaggagggcctggatttcaagtcctccgcggtgcgcggtacctctaccatgcttatgtccattctggccggcaccctcactactgtggtggtatatatccccatggctatggccgagggacttgtggggatgatggccggccccttgagttggaccatccttcttaccctgagctgctctttcctgtgcgctgtggtagtggtccctctggcttttgtgtggctcaagccccgctccaaggatgagattcctgtgaaccgcctgttgaatcgattcaaaaatttttaccgtcagaccctgcccaaactgctgcgccaccccggccgagttgtatccgtaggctttgcctgctttgctgttgccctcctgctggcgagtcagatggagtttgtccttatgcccagcaattttgacggcagtgtgacagtagatgtcagtttccgctccggtacaaagctggaggttatggatgagcgcatccagagcttggaagccgccctcctagccgatgagaattttgagcgggttaccttggacatctccggcagcacggcttcctttaccgcctacgccatcggcaactgtcagcgcaccagcgaggaggctgtagaggaatataccacccgctttggcaatctgccggacatggacgtatccatctcccccagcggttctatggatatgagcgccatgatgagcagtaacagcaaggatgtggtgctcctctccaacagcctggacgccctgcgggagacggctgagcaggtggatcaagtaatggcccaggttcccggggtcatccgaattgaaaacccctttgacgatagccagtctaagggccgcattgtcattgactcccaaaaagccttggctatgggcacctccgagtcggcagtggccatgcaagtatattacctgctagatggcctaaccgctgccagcgttgagtatggtgacacagagtacgacgtggttctggagtatcccgagggaaaatatgatgacatcacctccctgatggactaccccatctccacccagagcggccagcaggtcgccttgcgggatatttcaagcgtggagtatatcaccaccctgcccaccatcacccgtcaggatggccagtacagcgtcaccataactgcaacaaccaccgactcggccaaatatgacgcgccaaaggagattgacgcccgggtagcccagctcaccttgcctgaaggcgtatccatcggtgtggggatgatggaccagagcactgcagatggcctggagagcatgtccctagccctcatggccggcatcttcctcgtcttcctagtcatggccatccagtttgactccccgcgcctgtctatcatggttatgatgtgtatcccgctgagcctcattggctccattggccttattttcctcaccggccgccctatgagcatggttggcttgatgggtttcttgatgctagtgggt

SEQ ID NO: 2179 - DNA, 1809 bp, Unknown
  Artificiall/Consensus sequence
ctagagcgggcagatgccctgatgtatgaggataaaaagaaacaatatgccgggaaacgacagggcaatgccagcggcggatggtggggcggagagacgacagccctggcaaaacagtcttcctcacggctccgggaattcctacagagctattacttcgacgtggactcctttttccgttctgttgccctagtagacacctctctttacctctactgcggagatctgaggcaaaatatttattacatttccgacaacttaaaggaagagttcgactttgaggacaatctggtttacaactttgtggagcgcttagaggagcggatctacggaccggatcggatgcttcaccaagaggatatgagggagatgtatgcggaaaagcgggaaaaccactatgtccgctaccggattcacgacaaaaatggaaacttggtctggatgcgctgccaggggatcatcaagtgggatcgggaaaaaaactaccctattttcttctctggcagcatgatgaggctgaaaaatgaggcggagatcgactcggtcacagggctgatgcatatttcctatgcggtcagaaagctgccggcactccaccagtggagcgggaacatgactttgctctgcattgtctgccagaacttttccgacatcaaccgcgcctttggtcggaatactggggacacagtgctcctggaggcctcggagcagttggaacgggaactggaaggacagattcagctcttccggatggatggcccccgctttctggctgtagcaaacgggatgccggatgcgggcctgctggccaaacaaattcaacacattataaagggcatataccacaaatacggcattgaactgatgtatccatgtgccattggggtcctccacggcagcggtgggacccaggtcccgcagaccctggtagaccatgccggggtggcggcccatattgccaagtcctatccagggctggattacgtggagttcagtccccagatgctcaaaccctaccaggaccgctctgatatgaacttggcgctgaatttcagtgtgaaccacgattttcagggctttcgggtggtggtgcagccccaagtgcgggcgggagatggaagcatttttggcggggaggtattgctgcgctggcagaatcagggggagaatgtcactccggacaagtttattcctgtgctggagcagactggcttaattatccccgtaggaaagtggattttggagcaggccatgatagctgccaaacagattttgacttaccagccggactttttgatctcggtcaatgtaagctatcttcaaatcatggaccgtacactgtttagtacaattcaagggttgctaaagcaatacggcgtgtcgccccgcaacctccttttagagcttaccgagacccactttgacgagatgccggactacttggaacagtttgtccagcagtgtgggagcattggcatccagtttgctttggacgattttggaaaagcatactccttcctccagctcttgctgcagtatccggcggatttggtaaagctggaccgctcactgaccgtggaaatcacctcctcagaggagaagagaagctttatgcagagtattgtctacgcctgccacaaatttggcaaaaaggtctgtgtggaaggggtggagacgattgaggagttccgtgtggtgcagcggatggagtgcgattttgttcaaggcttttacttctaccggcccatggagctccctgacctgaatctacttctggagcagaccacccaaacaaccgtaacaaagtaa

SEQ ID NO: 2180 - DNA, 1530 bp, Unknown
  Artificiall/Consensus sequence
atgcaatacaactcgggcaaaacggagggatctattctgggcaagcgaaccattttacagtactggcagcccttcttgctggtgctggcagtcattctgacagcggtatgcgtttggaacacccacctcttttctaccaggccgctggccgagacttacctgtttgacgggccttcgggggtttaccgtggagaggacggtaggacctacgtagtggacacatcccgcagaaatatcctcatcttaaacgaggagatgtcctatgtccgtaccattgagggaggtagcacggaggagggcagtttttattatgccactgccgtagccgctgatgagagcggcatttatgtggctgatgccctttactctggcgtaggtaccattatccaggctgagcgcattctgcgctttgagccagatggatccggcggagaactcctctaccaaattgactaccctgacccagatactgcccccagacagtacggccggatcgatacactgatggtgcaggacgggcagctcttttttaccttgtcggaggagcaccaggttctggtctaccagtatgatctgtcggctggaacggtagtatcatcggattatgatttcggggagagctatgtcgctttttccgccctggacccgtccacaaagctgcccgttattcttgccggggataccagcatccagaaggcggacagctccgggcgggtgtccatccacgcggtggtaggggagttcccctatcaaggggctgtcacggaggatggcacattctggttctctgaactcaacacgggcgctctcatgcatatgacccaggctggaatagaggtggcctccaacgatgtcttcgcctactatgtcagcgcctatggaaataccgtctgtatctctgacggcacaggcgtagcggtctatgaggatggaaagatgtcctattgggaccaagtccccattgccaatgcggctgtccgaaacgtgatgtggggcctactggcggcctgcgcgctggcctggctggttctgctggtcttggctgtccggcatgtggtgcggagctggctggccttccccttcttccgcaagatcgcagtggtaattctagtggcggttgtggcttcttccacggtggcatggtacatcctgagcactaccttccgggaggaggaggctactaccatggcccagttggaggcgatctccgatgagatcgtggccaacaccaacgtggacctggtccggcggattcactcctccacggactacaaggggcccgcttataacgagctcaaggaagacctggaccgggtgatcgatgacggatatggccgcggcgagtacttctattatctcacctatgtcacggacggtgagctgatctacgcactgatggactacgaggacacggtccgcacctggatgacatatgaggcctacggtgtggacgtttacaccgatgtctttgagaccggagagcctcgcttgattgaaggtgaggtgagtacctggggctcctggacactg

SEQ ID NO: 2181 - DNA, 1548 bp, Unknown
  Artificiall/Consensus sequence
gcctccggcgtggtggaggagctaaaaatcggcatctgtaaggaggtcactcccaggagcctggcctctgagagcggctcttttgggaggatgaactacaacgccttttgtgccggcacttggctgacccgggatgaaaacaatgagatgcagcccaacctgatgacctcctgggaggtcctggatggtggcaatctcatccgggccacttttgccactgaccagggcatcacttggcatgacggggagccgctcaccatcgatgacgtcgtttttacggtagacctgatgaacaacaggctcaactcgggctacctctctaaaatcacctctgtggagaagattgacgacactacagtggagttccatgtggctgacggggccgcctactttaccctgggaaactccgctgtctttgtgcgcatgtacccgaagcacatctgggagaacattgaagacccggccagttacacaggggcggatgccaccatcggatgcggcccctacaagctggtaaatgtggatgaggacgcccagacgatgtactatgaggcggtaggggatacttacatgggccgggaactcaccgtccgcagcgtaacagtccgcagctatgacacccaggatgccctggtgatggccttatgtactggcgaagtggatgccatgtatgactactctaaccctatccctcccactatgctgccatccatcaccaatgtggagggcctggattccgggaagggcatgaatatggggctctttgagattttgttcggcttcaacaagcagcccactgatgaccttgctttccgccgggcggtgcgctacgcgctggattatgagctgttggctaccaccattgggggggaggatggccagattcctggagagggtatcatctccccggcggggattgcttacgatgacagcctgccccaactggtccaggaccaggagcaggccaaggagatcctggaaaccgccggctatgtggatgtggacggtgacggctatcgggagatgcctgatggcagccctatggacgtgcttgtgacccctcagtataacgccaccaaggcggctctctaccagcgcattgccgagatcatcgtgaccaacttaggggaagtgggggtgaaatgcaccctggatgaggagagcatccggaactctgaccatgagcagcagctccgcaatgagggcgcttatgagatttatatctgctatgccactcagggtgtctccttctacaagacccccttcctctacatgtttaacgatgacttgagcatgtggggaacctgcgacctggagcgttttgacaccgcctataacaagatgctcaatgcgcaagggccggaggattacgcggaatatgttaaggagcttcagcatgtggcttcggaggaggtggtgggcatcgccctgtgctgggacaacgcctattacccttaccgcacagacaaatatgagggttggaccaattatccgggctggggcgttatcaactgcgagacttggtatcatttgcgtcccattgcctga

SEQ ID NO: 2182 - DNA, 1530 bp, Unknown
  Artificiall/Consensus sequence
atgaaaaagatactttctctgcttctgaccatatcgatgtttgtctccattgtaggatgctccggttcaccagggggagggggggctggcgggacgccttcggtccaggaggaggctccagttaccctcaaaattgggacaacaaaagctcctgaggtgctgagcattatgtatgagcgggatgcctttggccgcatgaattatacaggtatctgcgcggccgcatttgtagaccgcggggcgtctggagaattgcagcccaacattatgacaagctgggtcatcagtgaagacaatactagcttagtggcggaatttgccacagacagaggaattctctggcatgatggagaggcattgaccatggaggacatcatgtttacctttgaatatgatatggaggtacgaaatctcagctatatccatggactggcgcggatagaaaagatcgatgatacccacgcacggctctactttgacagtccttgtgcttataatttcctgaatgcgattgcaatgacagtctttgtgctcccgaaacacatctgggagggaattgataatcctgacaagtacacaggcccagaggcggcgattaactgtgggccttaccggctggccagcgtggatcgggatgcgcaaactatgtactacgagtcagttgaaaattactggaagggggacttggcggcagatatcgtcagcgtgcgtacctatgatagtaaggatgcccttattatggcgctatgtaatggagaaattgacgccatgtatgattattccagccccgtggatgcgacaaagctctcatccattacaggcgtggaagacttgaatcccggtatgagcgacaatcctggcaactatcagattgtatttggtttcaatgaagcgccaaccagtgacttggcgttccgaaaagcggtgatctgtgccttggactatgagctcttggcagtttccattggaggagaggaggcgcaagtgcctggcgccggcatagtagctccgccgaacttgggttttcgggaggacttacctcaactggcgcaagacgtggagcgggcacagcagattctggatgaggcgggatacctggatgtggatggcgatggctatcgggagatgcccgatggtagccccatggatgtgctggtgactccgaatagtgcccagaccacatcaatttacccgcggctggctgaaatcgtatcccaaaacttggccgctgtaggggttaaaaccacaattgatacagagcatctggtcagttctgatgcactcagggaatttatttacagcggtacttatgagatctatctgggggcaactacctcgggaaaggctgcccatggcaccgcgtttttctattttgtgcaggaggacaatgggacacactggggtacctgcacaattccagaggtattggagacttaccgcggactgaagacagcctcggatgaggcggcttatgtggagacattggaaaggctccaggagcaggcgatggagtatgctataggggctgct

SEQ ID NO: 2183 - DNA, 1182 bp, Unknown
  Artificiall/Consensus sequence
atggggaagaaatacacggaaaataaagcattcaatatgatcctggctatcctcatcgctcttgggctgtgggtctatgtgacatccctggatactaacgtgggagagattaccattcgcaacattccagtaactgttgtgggagaggaggtcctgaacaacaagggcctgatgctggagtcaggtaaaggtctgacggtaaccgccagagtcaacggcaaccgaaatactttagtgagtatggctatggacccttctcaatattttactgctaccatcaatgtcacggagattgacgagccgggaaattatgatttgacctgtacagtcacgccagtaaattcacctttcagtctcagcagcgttcaggtggtagatcaggagaagcaagttattcaagtaacagtctcacggcttttgtctacgcaaatcccagtgcgggcggtttttgaaggtactgttgacgaagaaaacggttaccgtgccaatgcggcggaagtcactcccggcaccatcaacatccagggtccagaggagttggtggagcaggtatcctatgctcaggtcatcatcaccggagagaacctcaccaaaacctacagcggggagctaggcttccagcttatgactgaggatggtcaggtggtggagagcgaaggcatcactaccaacgtggatactgtgagcgtcgtgctgccagtggtcaaaacgctggaattgccccttaccgtccagttcgtctatggaggcggtgtgacagaagagaattttgaccgctatgtcacttatgagattagtccctctaccatccaaatttctggagatgaaaccgatattactcccctagagggttcctctattactttgggagagattgatctctcccaggtcattcaggatgggcagacctataccttccccatcgagctctccccagaactcacgaatgacagtggtatcacccaggccatagttaccatcacggtcagcggcctggagacgaaaacagttgagacctccaatattcagatcatcaacacaccggagggctttactgcagacccagtaactcagagccttcaggtccaggtccggggccctgcctcctctttagaggacgtagaaggatatcagctccgggtggtggtagacttggagggtgagaacctccggcaggcacaa

SEQ ID NO: 2184 - DNA, 981 bp, Unknown
  Artificiall/Consensus sequence
atggtggagcaaccagcagaagacagaaagaagggaggccaggtctctgtagtccgaggtggcgcaggtcatcctcctatggccattactgagattgaaacaggcgatgaattgcgcttttctactggattatctgagctagaccgggttttgggtggaggagcggtacagggatctctggtcctggtaggcggcgctccaggcatcggaaaatctacattgatgctccaaatctgccataatctctgccagttttctaaagtactttatgtttcaggagaggagtcccagcgccagatcaaacttcgggcggagcggttgggggtacggagttcctccctatacctaatggccgagaccgatctcagggatattttagaggccattcagacgctccagccagatgtggtcattgtagactctatccaaactgtgttcagcggtgaactaactgcctctccgggcagtgtggggcaagtaaaagagtgcaccatggcattgatgcagttagccaaaggagagggtattactgtctttgtcattggccatgtaaacaaagagggttcgattgcaggaccaaaagtgcttgagcatattgtagactgtgtgctctattttgaaggagagtctcacatgtcctaccgcattctgcgatcggccaaaaaccgctttggagccaccaatgagatcggtgtttttgagatggcagatggcggtttgacgcaagttcctaatccctcagaaacgttactggctggacgccctttggatacgccaggcccctgtgttccctgcgtgatggagggagtgcggccagtattggcagaaattcaagccttgctggctcctagtgcttatggaaatggtcgtcgcaccagcaatggctttgattacaaccgggccatgctgctgcttgcagtattggaaaaaagggggggccttatggtgggtggctgtgatgcctatctaaacgtcattggg

SEQ ID NO: 2185 - DNA, 1794 bp, Unknown
  Artificiall/Consensus sequence
atgaccgatcaggagttttggaataccttttccatccagctcaatcttcaacagaaaaccgcagtgcgtcagacggaggggcctgtcttgcttctggcagttccgggaagtggaaagactactgttttggtggccaggctgggctacctcctctattgcaagggagtctctcccaaacagatgctcactgttacttatacagcctctgctgctggggatatgaagcggcgctttcaatcactctttggagaaaagtacgccggacagatgacctttcggacgatcaacagcatgtgttcctccatcatccgtttctatgctcatcaaaaggggagcattcctttttctttagcagacaatgagagccaaatcaattccgtgttacgggagctgctcgcccggaccggaactgtctatccctcagaacagatgattaaggatgccaggacccacattacctattgcaagaatatgatgttcaccgaagcggaggtccatgctcataagatggagggcatggactttccagcagtgtattttgagtaccaggattatctgcgccggagccacctcatggattttgacgaccagatggtcttcgccctgcgtatcctccggagggaaccggacatcttggcctattatcagcggcggtatcgctacctcagcttggacgaggcccaggatacctccaaaattcagcacgccatcctggccctgctggcacagaaaaaccgtaattactttgtcgtaggggatgaggaccagagcatatatggcttccgcgctgcttggccccaagctttgctaagatttgagcgggattggcctggggccaaggtcctgctgatggagatgaactaccgctctaccaagtctatcgtagagcgtgcagacatctttattcagcgaaaccaggaccggtatcccaagcatatacggacagaaaatccacagggggagcccatccgaaaaattgaactggccgattacagccggcaggccagctacctgttccaagtggcccgggactgccgacggtccacagcggtgctctaccggaacaatgacagcgtgctccctcttctggatttgctggagcgggaaggggtgccctacgcctgtcggcaacgggagagctttttctttacaagccctgtggttcgggacctgacagacatcctgagctttgcatttaatgattgtgatcgggaaacgttcctgcgcttctattacaagctggacctgaagctcaaaaaaggcttgctcacggatttactccgcttccagcgggagaacgagtcggtctttgagaccctgctgaacacggacgccctggaatcttggcagacgagccggataaaggctattcagacccattttgcaaagctgcctcagctcaccagctttgcagccctccagcgtattgtgaaatatatgggctatggcgcatatatgaaggaacagaagctcgacgcctctaaaatagatatcctcttgtccctggccaatcaaaccacggaggtgggggcctttctgccccggctccgtgcactcagggaagtggtagaggaaggcggcagggaggactgcccctttgtgctctccaccatccacgccagtaaaggattggagtatgaccgcgtaattctccttgatgttgtggacgggggattcccctctgtccgggtaagtgaagcgctatctctggaggaccgggttacgctggaggaggaacggaggcttttctatgtgggcgtcacccgggctaaagaacgcttggagctgctgacc

SEQ ID NO: 2186 - DNA, 1278 bp, Unknown
  Artificiall/Consensus sequence
atgcgctacacctatggggatttggcccgccgggccaacggcctggccagatatctgcggcttgggctggggcttcagaagggggaccgggtggctgtctgcgcccccaatcatatggcatatattgacctcttttatgccacgccctggaccggcctcatcacgaccgcctacaacggaatgatgcagccagaggaactggagcaggtggttgccaacgagtctcccagggttctgttctatgatcccgtctaccgtgagaaaatccagtatcttcaggggcggacggcactctcctccattgtctggctgcccctggacgatacctatgaggagatcgttaacacatctggagaggcactttccagagtatccattgggctagaggacattattatcctgatgcacactggcgggaccaccggtactcccaagggcgccatgctctctgcccgggcagtcatgctcaacgctgtgggacagcagaacacctacagcctcaccagcagcgatgtcatgtatggctacctccccttttttcacactgctacctggcacaccattgtcatgccgctgctttatgcggggggatatctggtgttttccacccacttccacgcccaggaaatgctggagatcatcggccgggagcggcccaccatgatttggggcgtgccaacagtgtaccggcgcctctcagagcaccccgatttcgaccaaaccgacttctccagtgtgacgcggtgccgttgcggggccgcgccccctccactagaccttatggaaaaatattggcgcaagggcatccagttttgcaacggctatggcatgaccgagacggggcctggaaatctctccatcccagtgggggagcttaccctggaggagattcgggctaagcgtacttcctgcgggaaggtgatgccctatcatgaggcaaaaatcgtggacccccagggaagagaggtgtccgacgggcaacgcggggagcttttgatccggggcggagggctcttttccggctactggaggaacgaggcagccacgcaggcggccatgccggacggatggatgcataccggagatgtggccctaagggatcaggatggctttttttacgtggtgggccggctgaaaaacatgtatatcaccaatggggaaaatattttcccctcagagatcgaagcggcccttttttgccacccagatgtgcaggatgtctgcgttatcggtatcccggatgcggaccgcggcgaagttgggaaggccatcgtggtc

SEQ ID NO: 2187 - DNA, 1548 bp, Unknown
  Artificiall/Consensus sequence
ccggagcgcagctttacacagctatacatgctggacggccagccagtcacccgatcccggctactctatctgggtacgccggacaccttcgtccaggcagccgatcacctggttgccaagcggtgctttcccacttttgtcttggctggagacagccccgccctgtcggcctaccgggagcgggagagctttaatctgatcgctacttccctgtccttgccttctctatgtaacctgctctacagtgtgactgccgataacaacctctggtatcaaagtatgaaccttcatctttacgcccggccagatctgcccgccctactggaatgtggctctaagaaactgaactgctacgcctgcctgctggacgccggcggcaagctcctctgttccagccctggcccggtgccgccagtagctccgctggtccatatggaacgcgagacctatctctctctggagggcctcaacaccatccgccaggcccacgagacctctggcgaggattggttcccgctggatggggaggatggggtctggcggttacgagtctaccctatccaatataaatcccaagtggtggcccaccatctcatcgccttgcccgaccaaatctgcacccctgccgctcaggaaatggcaaagctcttccagcggtgggtagagcgttttgttttgcgctataaccgtgagaaatatgagtccagtaatgccttgagttccctggtagctgacctcatcgaaggccgtctctccgagtcggaacagttggtagcccgtctcaagcagctccccgtccatgtaaaaaaatactaccactgtttggtgattgagttagaaggctacgccagccctgcccatatggggcagctcatgcgggagctggagcagattttctcttccagcctcatcaccacctatcagagcgacgtggtcattttggcctggaagcccaggcattactctgagcctaggtttgaccatgacggcttccataggctgctggagcgttatgacgcacgggcctgcatcgggaactttacccgttggctcagctctttaagaaacatctaccagcagaccaaaggcgtcattcaatatgccagagtcttctgccctgatccagcacagcgcatttatcggtttgaagactacagcatgtaccagatcgtggggctgtgtgtggacaactgccaatcctttcacggcggtgacccggtctatctctgccatcctggtgtgatcaccctagtggcttccgattctaaaaataacaccaacctctttcaggtcctctccacctatctgaaaaatgatagaaacctcactctaacagcgcgagacctctttttccaccgcaacacccttcagcataaaatcgaaaagatcgagtccattattggggagagcttagactccagcatgatccgccagcggcttatgttttcctgcctggtagtggaatacatacagaaatatctaaaacgcggcgacgtatatggccggaaacggaacagtcctcccacctccgccctgatggaggactga

SEQ ID NO: 2188 - DNA, 1584 bp, Unknown
  Artificiall/Consensus sequence
ggcggcagtaccagtgcctctctcttcaccgacgtaaaacaaggccactgggcgggcggctatatcaagctggccgtggagcagggctgggtctccggatatgtggatggctctttccggccggacagcaccatcacgctggaagaggcctgtaccgccctgctgcggctgctgggttatgactcgtccagtctggccggttcttacccagacgcccagctctccaaggcccgggctgtaggactgctggatgacctgaacgcctcccaggggcagacgcttacccgcagagattgcgttatccttttctatcacctgctgacagcggaaaacagctccggcactgtctacgggaccactctgggctacaccatcaccaacggtgaagtggactactccagtctgatcaccaacgacaccaaagggccttacatcagttctaccggcaccgtcagcctccccttcagtgcggaaaatatgacggtctaccggaacgggacccgctctgacctctctgcaataaaacagtacgatgtgtattactacaatgaaaatctacgaactgtatggatctacagtgaccgtgtcaccggcaccctcaccggagtctcccccagccgggctgctcccacctctgtcaccgtggcgggagcagaatacagcattggaacctctactgccacatacaagctctccagtcaaggcagttttgctgatggagacacagtgacccttctgttgggcatgaatggcgaggtggtggatgtcctctcggcctctgtcagcagcgcctcctactatggagtcgtcctcagcagtgagaaatccgcctctacctccaacaccactacctcggagaacgcttccattcaagtagtcacacaagtggcttgcaccgacggcgtagcccggaccttctaccatgagggtagcgccctgcggactgggcgggtggtatctatcacgataaatggaaacggcacagccatcaagtccctctctgacaaatccctcagcggcagggtcaacgccagcggcaccacctttgctggctactcctttgccgaaaatgtagatattctggacaccgacagcgaggggggctatgcctatctctaccctgaccgcctctctggcacagagctggagcgttctgatgtacggtattacacgctggatgaaaacggtgacatcgactgtctgattctcaatgaggccactggcgataccctggactacgtctatgtcatctccgccagtgaactcaactccgacatgaatgtcacaggcacttatcagtacctgttgaatggcaatctccagtcgattagcggcagcacagtctacaatatctctgtcggcggagccgccctcctttatgacaacagctccatccagagcatccggcagttggagtcggtctcccttacagacttgacagaattttctgctatgtctggaaaccagcggtacctgttggatgaggcggtccaggtttatctacgggacagctccggagacctttatgccactactctcagccaggtcatcggctcagactatactcttcgaggctggtatgat

SEQ ID NO: 2189 - DNA, 1068 bp, Unknown
  Artificiall/Consensus sequence
ggcgaaggaactggacccaacatcctgtttaatggccacatggacgtggtcccggagggctccctggagaactgggcgccctatgatccctataagcccgagatcgtagacggcaaactgatcggcagaggcatcagcgacatgaagggcggtttggcggcccaggccttcgctttcttcagcatcgtggaccgtgtgattaagaagggcaagaagctcccaggcgacctggtcttcaatggtgtggttcaggaggagcctgctgagatgttcggcacagagtacttctttgaccacaccatgaaggaacacaacctaaagttcgacctttgttatctgggtgagccctcctccaaccggctggctatcggccagagaggtaaagtggagctggtggtgaagacctacggcaagtgcgcccactcctccgctccccagcagggcatcaacgccctggagcacatggtacccatcttacaggatatcttcagccataccggaatcgagctgaagaccgatcccgtactgggcgagacctgcatcactgtcaccaactgcgttgtgaagccgggcggaaccctcagcgtgattcctgatgagtgcgagatctccattgaccgccgctactccaccgagcagacgctggatgacctcctgggcgagtttgaggcgattttcaagcgtctgaagacggcttatcccgacttcaaggccactgtggagccccgtgtgtacgaggagacctcttacaccggttacaccaataaggtgaagaagttccaccccgcttggcgcaccccggaggacaatgagttcgtggtgaagtccatcgaggctctgaagggcatcggacagaaggctgagaccacctactggaagttcggcactgacggcggcatgacttgtgccctgcacggcatccccaccattggctactctggcggcgaggaggctcaggcccaccagcccaaggagtatgtgtacattgatgagatggtaaagacctatgagggctatctggctatgctggccaagatctacggcattgaccctgaggtctttaactaa

SEQ ID NO: 2190 - DNA, 1002 bp, Unknown
  Artificiall/Consensus sequence
atgctggcggtcattgtgatccatgtctccgccggttggctggagtcgtcccaggtggggacggcggactggcacgccttgaatacctgggacgggctgtgccgctgggctgtccctgtctttgtcatgtgcagcggcatgtttctcctggaccccaagcggaacctctccctttcccacctccttctggggcattttttcaggatggctgtggccctgctggtctggggggtgtcttaccacctgctttaccagcttatcgccgggagcctctccctggccagtatcccatacgccttttacgctgtgattttggggaacaccgagacccacctgtggtttctcaccatgatgatgggcctttacatcctcacacctgtgctccgggcctttgtccggggggcttcccggggagatttccactggtgttttctggtttttggcctcttcatgttggcccttcccctctttctccggctccggggaagccagaccgtggccctgtacgccaatcagttttacctcaactttaccctggcctttccgcctcttgcctatgtgggctactttctggcgggctattatctcaaggcgtacaccctgggccgtttggctgagggcctcatttatgtggccggcatcgctggagggatcgccaccgtggtgggcacaacggttctttctcagcgggcgggagggctggatgtcacgctctacagctacctgacccccaatgtgtgcgccatgtcagtggccgtttttgtcctcttccgctatgtgctgggcgtcagcgacgagcgctctcggaagcagcgggtcagcggcatggcagcctgtggctttgggggctacctctgccatgtggttttcctcatcctgctgcgccattttggactggccattccgcccctcccctccgccatcggggtccctctgctgactctggcggtcttcctccccagctatgccctctcttggctgatccacaaggtccccgtggtg

SEQ ID NO: 2191 - DNA, 1233 bp, Unknown
  Artificiall/Consensus sequence
atggaggcgttctctttgctgacactgaattttatgaagaatgtttttgacgcgattgatgtcggtgtcacggtcacagacaacctgggaaacatcatatatgtcaacgccgcacaactgaaccgcagccactatacctatcaggagtacatgaatctcaatgtccgcaccctttatgagaccaaggtcagtgacacctgcctttttgatgtggccgcacagcataaaaaggctgtttccgccatacaacgaacctaccacaaatcggatggcagcagctacgaaaagctggtgaccgctacccccctttttgacgcagatgggcatgtttccaatgtcatcaccacttacatagatttggaagtctttcgcgaaaaatattcccaggcacttctcgcccaggaaatctcgatcaacaatccaaaggcggagcggggatatcaaagccaagtagtctaccgcagtgaggtgatggaacggctgctggatattgcggcatctgtggcggagagtgactctgcggttctgctctccggagaatccgggacgggaaaggaagtcatcgccacctttatccacaacaaaagcccccgctgcaaaaaaaagctggtcgcgatcaactgtgcttccctgccagagtccctcctggaagcagagctgttcggctacgaaaagggagcctttaccggggcctcagccgctggaaaggtcgggcttatcgcagaatctgatggcggtacgctctttttggatgaggtaaattctatgcccctgtcgatccagagcaaactattaagggtcctggagacaaagcaggtcaaacgtgtgggcgcagtcaaagaggagactgtggatttccgaatcatatccgctacaaatcaggacctgctggaatgcgtatccaagggacaatttcggcccgacctgttttaccggctcaatgtggtacctctggcaatcccacctctgcggcataggcgggaggacattgtccctttatgcaagttttttcttcaacagtatttcaagaaatatggcaagctgaaggtcctgtcccaaaacgcctatgctacactgcgggaatatgactggcccgggaatgtccgggaactgagaaattttatcgaacgcctggtggtcacaggcgcctcttctgccccatacatcaataccatctcccccgagatgttcggccgcccctatatcctggtgggcacctctgaaaataaggtg

SEQ ID NO: 2192 - DNA, 1365 bp, Unknown
  Artificiall/Consensus sequence
atgcaccggacagtcgtggtcaatttctacaattttttatccgcaatggcggcagcttttttggacgaagtgctggtgaaggacgggaggccctcggctacacttattccaaaaggaaaatgggggtggtatgcctctggagggatatcccgggaaaacaaagaaggaagggtgcattcccacatgaaggaaactgatgcgatttttcaagggcgcacaggacttggacaaatcattgactatgctgtcgcgcattacccggaccggaccgcagttgtgtcagaggacaggcggctgacttatcgggagttcgaagaacaggtctcccgctttgccctggtgcttcagagggacggcgtcaagccgggggacccggtcgccatcgtctccaggaactgcgcagaatatctggtggcggaatttgccatcctgcggttgggcgcggtggtggtcaaaataaattggcgctttgcccccgacgagctacagtacctcttggaatttaatcatgtacatcatgccatcgttcgctacgagcgaagggattggggccttcaggtctacgaacgcacccgggaccatatcaagttctatctgctcaatcccgacgaaagcggaggctcgcccttttgggctcagatccaagacgcccccacagaaaagctgatccccagagaaatggaggacgacgcccctgcgctccgcatccataccagtgggaccacgggacgcccgaaatgtgtccttcacacccatggcgcaatgttgcggcagattcgcaactgcctctccggcctggcctttgcccccggcgttgtctttcagatgaccagccagctcttccacatcgcctgcgtaggggcctatatgaccctggcagtaggtggaacccttgtgctcatgagccgttttgagccggaggaatacttggactccttcgaccgggaggaagtggacggtatcagtgtgattcccgtcatcctcaaacggctgctggaacgccctgatctcaatgagcacaatctttcccacctaaaattcctgaactactccacctgccctatgtccaaagcacttttggaagaggccatgggaaagctgtgctgtgatttttatcagtcctacggcatgactgagatggcctccatcgtcacagttctgaggccagaggaccacttttctgacggcggtcggcacctgtcctcggtcggcagacccattccaggcgtcgaagtgcggatcgaaggtccagatggcctcccttgctctccaggggagcccggggaaattgttgtccggggtcctgggcaaatgcacggctatattacggatgacaaggcgctcaatgacgatgtcttaaaaggc

SEQ ID NO: 2193 - DNA, 1353 bp, Unknown
  Artificiall/Consensus sequence
cttatcgagatcgctgaggaggagatccggcgttccctccagcgctgtctgatcacgattgacgtgcgaaagcgggaacagattaagacagagcggttccggcagagtctggataccgttcacgacggcttcattgggattgatgaaactggtcgagtagcagttttcaatcaaaggatggagctgattaccggcatctgtagacaggagatacttggtgttgagaaggacgaggccatccgccggtttgcctttctgcgtgaggtgtttcgggctgaggacgaggatattcttgaggtccacgaggaaaagtattcggtggcccgggagacctatatggtcgaagggcttcttttacaggaaattgttcggctgatcagtgtccccgagatacagaaaattgagggaaatctccgaaagaaactaaccgaaaaggggtttaaagccaaaagcacctttgaaagcatgtattgcgaatgcccctccatgcgatttttgaaagaaaaggcgcagaagtatgcggcttcctccagcagcatcctgattaccggagaaagcgggacaggaaaggaaatattggcgcagagcatacacaacgccagtccctttcggaacggaccgtttgttgccatcaactgcgctgccttgccggagacgctgctggagagtgagctttttggctacgagggaggcgcttttaccggcgccaaacggggcgggaaggtcgggttaatggagctctctcatcagggcaccctgttcctggacgaaattggcttgatgccgctgacgtttcaggccaagctcctgcgcagcatccaggagcggcagatctgccggctgggcgggaaccggcttatccccgtgcagaaccggatcatctgtgccacgaaccgggaccttttgcgggatgtgcaggagggcagttttcgggaagatctgtactaccgcatcaatgttctttcacttaccatcccccctctgcgggagaggggagaggacgtgaaatttttggctcgccatctgctgttgaaaaaatgccgggaaacccaccgctatctttttcttccggaacgatccatgaatttgcttcttacctacgattggccaggcaatgtcaggcagcttgagggttttttggaaaggcttcttgtactcacggagggggaaaaggtgtctgaagaaatggtgctggaattgttggatgagatgcgcagccgaagaaaagagagctgcaagcagcccagtgctctggtccccacgtcacttctgcaactgggttccctggaagatatccagcgggaggctatccggcaggcgtatgactgctatggcggaaaaatcgaagtcatg

SEQ ID NO: 2194 - DNA, 1362 bp, Unknown
  Artificiall/Consensus sequence
atgacggaacaactacaggtaaagcatttgattaagcgatatccaggggtgaccgcgctaaaaggcatcgatatggagctgtactctggagaggtggtagcccttttgggggaaaacggggcgggaaagtccacactggtgaaaatcctgtgcggtgtgattccttatggccaatatgagggcgagatttttctcaaaggggagaagctaaggctaaacgggatccgccaggcatcaaagaagggaatcgccatgattccccaggagctgaatatccacccggaactcaccattgcagaaaatatcgtgctcggcaactggcccatgcgcggcccctttgtggatcgagccagaatgctggcccaggcggaagaggccctggcaaagctggattttgatattgatgtcactatgaaagcagggatgctcaactccagcctccagcagcttgtgtgtattgcccgggcactgctccaaaatccagatattctcattctggacgagcctacctccgcgctgaccaaggcagaggcagagctccttctggagcgggtgaagagtctgagagaccagggaatatgctgtatctacatcacccacaaaattgatgaggtattcaaaattgccgaccgtgtcattgtttttcgggacggcagcctgattcggacctacgcccgggagaagatggagaccagtgcgattgtggaggacattgtagggaaaaagggaggagacgcctaccaaaaggtctcttatgccacagacgaggtggtactcgcctttcaagacttttctatccggcatccctatgccaacaataagatgctcctggaaaatgtgtcctttgatctgaaaaagggagaaatcctgggcctggctggcctggtgggcaccggacgcagtgagctcctaaaggccgcctttggagcgctgccaaaggtttctggcgttttgtccctcaacggtgcgccggtggaagtgaaaaagacctcggatgccatccgactggggattggtctgctcacagagaaccgtggcctggacgggtatgtcaagaccatgaacgtgggggagaacatgactctggcaattctccgaaagctctccaggcggggatttctggaccagcgccaggagaaagccttgacgaaagagtatttccagcgactgtccataaaagcgccctcagcccggacccccattctgtccctgtccggagggaaccaacagaaggttttggtggccaaatggctcttgaatgactgcaagatactctttctggatgaaccaactagaggaatcgacgtgggcgcgaaagcagagatctatagtctgatggcggagctggcccgtcagggcaca

SEQ ID NO: 2195 - DNA, 1080 bp, Unknown
  Artificiall/Consensus sequence
atggcagaccaacgtttggtctatgccgacccctgtgatctggacgctttgcgccaggccctggcggacaacgaccccgagcacaagctctgtcccatccagatggaccgcatttatatccagcaccaggccatcgagcttctccccgatatcattcaggagcacaccaaaggtcctaaagtcctgatggtcactgacgccaccccctactatcgcggggagcggagtttgaaggaagaaatctactttctcctcagccgcacctatgacgtgcgctggctggtgctggacaaccatgaccacgtgctccatgccgtggacgaagagagtcagaagatccagcaggccatccgggcccaccaggccgattgcgtcctggggatcggcggcggcacggtcacagacttgtgcaaagacgcagcccacgccgttagcgacgaaatccccctggtcatcgttcaaactgccctgtctgtcaacgctttctccgatggcatctccatcatgttgaaaaacggtgtgaagagctcccttcccacccgctatccctccgtgttggtggtggacctggacgtcatcaagcaagcgcctatggagcgcaacctggcgggctacggcgatgtgatggctacctggaccgctccagtggactggtatctggcctaccggatgggcatgaaccagacctataacgacccctcttgcgacatcctgcggacccagaatgcccagctcctggaccagtcggccaagttggcgcagcgtgacccggagaccctccacctgctggcccgggtgcttaccctcagcggcttggccatgggtatcgccggggagtcctgtccctcctccggcacagagcacattatcacccacctgctggacatgtcggctgaccgccagggccgcgatgtggctttccacggcgcacaggtctccattggcactattttcactgctatcgcctgggaaatccttttggccgagtttgatcccgcagagctggacctggatgcctgttatccctctgaggaggaaatgcacggcaaggtccaggatgctttcctctggatcagccag

SEQ ID NO: 2196 - DNA, 1224 bp, Unknown
  Artificiall/Consensus sequence
gtgtttttggcgattagctcatctctttctcccagtataacaaataatttgcaaaaatcaactaaaaattctcattttatgcccttgatttatccaaagtttttggataaaatgagagcaatgatttggaatatctccttgcaactaccttccccctgtctctattttatctttacattgggaggtcatttcatgccaaaagctacgctctatgaaattgccaaactatcaggagtatctatttctactgtctcacgtgttctgaacggagacacaaaaaaacccgccagcaaagccactgcggcccgtgtaatccaggccgcatatgataccggctatttggcaccgggactccgcggaacagaacacaaggcgctcttgtgcctactctccaaccgtgcatacgactacagcgactatttttattcagaaattttacgcggaatagaagcagaggcttcctcaaatggttttcatattagccagcagctttccgacatcgggatcgatgatgctgttttaaacgatcactttgtagacggctatgatggtctcatattgttgggacgtgtttcttttgagaaggtagaatacttaaaatctctcacctcaaatattgtctatgcaggcttgaaccgtgtggacagcggttttgatgaggtcatttgtgacgcatatgaagcgattcagtcgacagtggactacttggttgactgtggacatacacgaattggattcatcggcgtaattccgcccgaaggcggcaaagaattggtgaatgaacatcgttttgcaggcttttcaggggcgctggcccgtagaaatattccactggacttacgttactgtaaaaacgttgagctgaagtcagaattttcctatgaagctgcaatggaattagtaagggaaaagtgtttgcctgatgctttggtctgcgctacagataatgtagcgcttggggttattagtgcattccggaagtgtggcgtccacgttccggaggatgtatctgttgtcggccatgacggaattgatatatccggtttctttgagcctaaacttacgaccgtgtacatgcagaagagtgaactgggcaagtttgctgtcaagcttctggtggaccggattaccggtgggcataccattcccgttttaatcaaactgccacacaggttggaaatacgtgacagcgcattagatcttcgtctgttgcaaaacaaatga

SEQ ID NO: 2197 - DNA, 882 bp, Unknown
  Artificiall/Consensus sequence
atggagatatttgtccgagatcgggaattctaccgtaaaatgctgcggattggcataccagttgtactccagagcgcaatcactatcggggtgaacctgatggacaccgtcatgctgaacaaactaggggagattcaaatttccgcctcctcgttggccaaccagatcaccaacctgttccacattttctgtatgggggtcggttgcggcgcctcggtcatgaccgcccagtactggggcaaacgcgacttagaaccccttcgccaagtggtcaccatcatgctccgctgtatcattgccgcaggggccctggtcatgctactggctctgttcctcccggactatcttatggccctctttgcccccggcgatcaggctgtcatttcggcaggggttgagtatttcacctttctggcctacacctatccactctacgggatttccctgaccatcacactggtgctgcgcagcgtgagttccgtacgtctcccccttttcacttctgttttagttttcttcatcaacgtcttctttaactgggtctttatttttggcgcgctgggcgccccccggatggaaattgccggtgctgccctgggcaccctgatcgcccgcgtggtggaggttgtgattatctgcgctttctttttccactgggattctaaaattggttatcggccccggcacctcatacagtcttgcagaggtcatctttccgccttctgccggtgcagtctgcctgtagtggtcagtgactccctgctaggtgtcggtaatacggcattagctatgattatggggcgcatcagctccgccttcgtagcagccaatgccatcaccatggtggtctcgcggcttaccaatgtcatcatacagggtgta

SEQ ID NO: 2198 - DNA, 831 bp, Unknown
  Artificiall/Consensus sequence
gtggagcagactgaacccactgagatccggcaggtcatcagcgaaaagacctcccagacggtgcgggatatcctttttagcgtggtagacagcggaaccggcaagaacggtaaggtggagggctaccgtatcggcggaaagactggcacttcggagaagcgggatgagaacagcggagacctgatcgtctctttcctgggaatagcaccggccgacgacccgcagatcgttgttctgctggcttttgacagccccaccccggtggtccccggcagtgactacacctccaagggcttttacatcagcggcggaaatatggccgccccatccggcggccccctgttggcagagatcctggattacctgggggtggagaaggtctatagtgactccacttacgccgacgtggtggttcctcaaacggtaggactgagtcaggccgacgcccagaacctgcttttatccaagggccttaactaccgggtagtgggggatggaaccaccgtcaccgatcagctcccatcctatggagtttccattccaggcagcagccaggtggtcctctatctgggagaggaacggccgcctgagcaagtggaggtgcctgacctcacccgtatgaccctcagcgcggcggaaaaggccctgacagagcggaatctctacctccggccttcgggcgccacatcctattccgataccaccatttcagtaagtcagtccatccagcctggcaccctggtgaacccagggacagtgatcgaagtccagttcatggacacctcggtccaggattatgcggaaaacgggaatatctcgtccattcattaa

SEQ ID NO: 2199 - DNA, 1086 bp, Unknown
  Artificiall/Consensus sequence
atgctctacaacgctgtccagtcctggatggtggagtaccggaacctggagggctcttatgacgggatcgtctatccccagcccctgaacggcagcaaggccaactccactgtactggtggagaagttcaaggtctccaaggtggagggcgtggtggccgccaccagtctcatcgctttggatggccacaacaccaccgtggacggccgcacccgtctcaccgacattgagtacaatggtgagctctggggcacgacctccggcggtacattcactcccacccccgtgacctaccccattgccatcgacagcgacctgctgggccagcgggtggttatctatgtaaagggtctcaacgacctggctcccaacgcctccggcatggaagtggtgggcactgccattgtctctgatgacaacactgtggtcaccaccaacggccgtctgaaggacgccgacgctgtgaaggacgccctgaagggctccggcatcgccgtggataccgcggcccagggtgtcaccatcacctggaatgacaccacaaagggcaccagctataccggcatcactggcgccgattcctaccccggcatggcccagaccttcatcgataacgacgatgacggtgtggtggatgtcatcatccagaaggcccccggcctgaccaaggtcaacacctacaacgagaacaaggagaccctgaacctctccggcatcggcactgtggactttgaggatgtcctcaatcccgaggacgtagcccagggcgactacgtgctggtctataactatgatgatacctatgtactggaggccgctgagtctgtttctggcaccattagcgcctatgtgaacaacgccggcacccagcacctgagcaagatcaccgtggacggcaccaactacggctggagccagagcgagaacctggcccccgatctgctggaccgggatgactatcctgccgcccggctggaggatctggtagacggctcctacaccctgtacctggatccccacggtaacatggtgggtctggtagaggatgaggccgccgtgggcaactacgccgtcatcaccggcgtc

SEQ ID NO: 2200 - DNA, 1137 bp, Unknown
  Artificiall/Consensus sequence
atggagatgaaatctgctgcagagctgttgcgtcagtttgaggagatcgcgtcaaaccccagaaaatccatggaggaatacaagaaggagaccggaaagggcgccgttggcatcatgccagtctactgcccggaagagatcgtacatgccgccggatacctgcccattgggatgtggggtgcggagcaaaagcagatctccaaggcccgggcctatttcccaccctttgcctgttccatcatgcagaccatcatggagttggagctggagggcatctatgacgaccttgaggcggtcattttttccgtcccctgcgacaccttaaagtgcatgagccaaaaatggcaccggaatgtgcctcagattattttcgcccatcctcagaaccggaaactggcccggaaagccgccaacgctttctgccgggaggagtacgcccaggtaaagcaaaagctagaggatatcctgggagtggagatcaccaatcgggcgattcacagcagcattgcggtctataacgagaaccgggctgcctgccgggaattcagcgacttagcagcggagtatgctggcaatctgacgccttatcagcggcacatggtcttcaaggccaggtggtttatggaaaagtccaggcacactgccctgctgaacgagctcatgtatgccatcaaggcagagggcaaaaagcccttccatgggaaaaaggtagtggtctccggcatcatgctggacccgaagggcgtcttggacatcttccaggaacacggctttgccattgtggccgacgatttggcccaggaaaccaggaacttccggcaagacgtgaccagcgacgacgatgatgccctcctggccttagcaaaagcctggaacgacttcgacggctgttccttggccacagatccggagaagcccaaggtcagaataattttggatgctgtccaaacatatcaggccgatgcggtgatcatcgccatgatgaaattctgtgatcctgaggaatttgatttccccgtcttaaaggaggccttcgacgcctccggcgtgaaatatcttcagatcgaggtggatcaggagtcggaggcctatgagcagatcaagaccagagtacagacctttgctgaaattctttga

SEQ ID NO: 2201 - DNA, 927 bp, Unknown
  Artificiall/Consensus sequence
ttggaagccatattagaattggtggcgatcatcggcaggatgctggtcatgatcggattgggatttttggcggcgcagctcggcgtcgtggaagagggcgcacgaaagggaatttccaatttggtgatcgatctcatctatccatgctatgtgatcaatagctttgtcaacaacattgggatgttcgacgggggagatatgctgtttatcctggcgctgggcgtactggtacaaggggcgacgctattatgtaaccgtttcctgtaccggaaggtctccaaagaaaaacaggcaatcctgcggtacggcaccgtggtatccaactccgcctttttaggggtcccgatggtggagagcgtttttgggaatgcgggactgatctgcgcttcaatctttgttatcccactgcggatcaacacctttggtatcgccatcagttactttttcccccaaaagggaaccagcatttttacacgggccaaacagctcctgctacagccctccattgtggccactatcgttggtatcggaatcatgctgtccggctggcggccgccggagtggggctgttcgatcctgtctacagtggcgggatgctcgactcccctgtgcatgatgaccattggcatggtgatccaggccaacgccaagcggattcatccgagcaagctgacagcacagtttaccctggcaagactggttctgattcccgcgattatttatgccgtgttccgcctggcggagctagagacagtgctggtggggaccgccgtcctgctggcggccatgcccattggcacgacagtggcactgctggcggacaaatacagcatggacgtgggctttgcgggggaactggtgctggtaacgacgctgggctcgctgattacgctccctgtttggagctacttgtgcctctacatatag

SEQ ID NO: 2202 - DNA, 1371 bp, Unknown
  Artificiall/Consensus sequence
gtgtacgtgaagcgaattgcgatcattagtaacatccccactaccgcggggactcatcaggcgattctggaaagcatttttcaaaatacctccatagaagtcgccacaatctttgaccgccagaataatcaattaaaggccgatgtagcggtagtcaccgcgctcgacctggtcccttatgcccaaaaatacctggatccggcctgtaccatcgttcagagcacttataccttggagaaaacacagctaaatatcatccaggagttggagcgcaccggccccatcgtggtggcccatgagtccccccgggcggccctggccaggcatacactgcttcagcggctgggcatccctgctgagcgaatgcgggtttggtatcccggcatggacgagaaaggattggcagggcacattgtcctctttggcgacatgtcgcttcccacgggatatatggaggaacttcgtattaaggggcgcctgttcagcgtgaccacgatatttgagatcgcccttggactgggcgttcacgacgtcacctcctcccaggggtttatggactactttagccgggtctgcacacagttccggccctctatgaatgacctcaccgtcagcgaatttaacgctgttaccggcaatgcagcccctcagcgcggcttgctggcctttaccgggaatctacacattttttactgtgacgcctatgtggcctcaatggtgcaaaagtccccacaggagctcattggccagtttctgtttgaggcgtttcccttcctccgctcctgtcagattcaccgtggcaatgagacccaggaacagcttgtggtgtatgacgggaaaacctatgcagtcaagctcaacctagttctccaaacgggccgggagactggctatctacaggtctctgattattgggcagaggagcagcgtcagggcaaactccgccgccaagtctccgggaagcggtctactgcgaagtacacctttcacgacatcgttggcaccagcaggaggctggcagagtgtaaggccatcgcccagcgaatggcccgctcagactccaacatcctcatcactggcgccacaggcgtgggaaaggagctctttgcacagtccatccacaatgagtccaggcgaaagcaccagcccttcatcgctgtgaactgcggcgcgctggtagaaagccttctggaaagtgaactcttcggctatgaaaagggggcttttaccggggccaacaagaatggaaagcagggcctttttgagctggctcaccagggcaccctctttctagatgaaatcggagaaatgccgcttcaccttcaggtccgccttctgcgggtgctccaggagaaggaggtcgttcgggtg

SEQ ID NO: 2203 - DNA, 1290 bp, Unknown
  Artificiall/Consensus sequence
atggcaactggtatcatgttcctggtgatgtttgctctcatgttcctgggtgtgcccatcgctgtagccatctatattgcaatgtttgttctgatcggcatgaatcccgttactacgggcaactttctggcccagaccttgtacggcggtgtagccagctttaccaatctggcgctgcccttcttcatgatctgcggcaccatcatggagaccgggggcctgtccaagcgcctagtgaaatttgcaaattctctggtgggcgggatcaccggctccctgggtatggtgaccgttatcgcctgtatgtttttcggggcagtgtccggctccgctcccgctaccgtggccgccatcggctcgatcatgatccccatgatggtctccaacggctataacaagtattatgccacgggactcacctgctgtgccggcggcttaggcgtgattgttccccccagttatcctatggtgctctacggcgtgacctgtaacgtctccgtaggggatctgtttattgccggcctgggtcctgccctggtagtgggcggcattctgatggccattaactacgttatgtgcaaacgctggggtattaagggcgacaccaagctgagcctgaaaaacgtggtccggagtgcctgggaagccaaatgggccatggtcatgcctattattatcctgggtggtatttactctggtatctttactgccaccgaggccgccgtcatcgcctctgtgtatgggatcattgtgggcctgtttatccaccgggagttgaagctggagcccctgtggaggattttcaaggacaatgctgcctttattgccggcaccatgttcattatggccccttcccgtgccactgggcaggtattcgcctacctgaatatcacagagatcgtctccaacttcatgttcagcatctccgataacacctatgtggtcctgttcatgatcttctgtatcatgtttatcgtcggtatgtttgttcaaaccactcctgctattgtcatcctggcccccaccctcctggccgtggtgtcccaggtgggcgtagaccccatccactttggtatcatcatgacgctggccctggccattgcctttgtcaccccgcctgtggcgctcaacctatttgtaggctcctcgatgacagggctgagtattgacaagatcgtaagggcctttatgccgttcctgattggtctgatcatcgcattctttgtcgtgtcctatgtgccggcgatttccctgggtgttctgggtgactggtccctcaccttcaactaa

SEQ ID NO: 2204 - DNA, 1296 bp, Unknown
  Artificiall/Consensus sequence
atgttgggaatggtcggattactggtcgcatttgcacttcttattgttatggcgatgcggggcgtcccgattctgctcatagggctggtatgttcggcaatcgttgcaatcaccagcggaatgaatgtttatgataccttccttaattcctacatgagcggctatatcacatttttgggaagcaacttcttgatcttcttggctggcgcattgttcggccggatgatggagatcaccctgggcgccaactcggtagcagactttgtggtaaaaaaacttgggaaagacaaggccgtcttagccattgttctttcatgcttcatcttggcctatggaggcgtaagcgtgtttgtcgttggctttacgatctatccgattgctgtcagcctgttccgggaagcggacttgccccgcgcttttttgcctggcacgattggttttgggtctgtcacctttgccatgactagccctggtacgccccagatacaaaatttgattccggcagaagctctggggacgagccccatggctggtgcagtagtcggtattattgcaggaatttttatgtttgttgtgggctccatttggctcaaccacatgatcaaaaagtccataaatagcggggtacattttgaagagagggcatcggatgccacgttttcctctgtggacgccacgaaatttcccagtccaatcctagcgatcatccctatcatcatcaccatcatttccatgaatgtgttcggtatcccggctcccatttctattgctttaagtatcgttgtcggcttggtcctgatgtttcgcttttatgattataaaaacctttttgatgacttttccaaaggtgcaggttctgcggtatccgccatcacgaacacctgtgcagttgttgggtttggcagtgtggtgaaatcggtccctgcttttcaggccctgattgactgggtaacgaatctccccatcctgcctctactcggctcggccatcgcggtcactgtactctgtggcatttctggctcggcatctggtggcttgggtatcgccattcccatcgtcggtcctatttacacagctatgggtgttcctgccgctgcaatccatcgtattgcgtctattgcatccggctgtttggactctctgccccacaatggctatatcgtaacccttctcaacatctgtgggtgtacgcacaaagagggatatatgcccctgtttaaacttacggtgattctgcctggacttgccacacttttgtcaattctattgttctattttttccccaatctcccctga

SEQ ID NO: 2205 - DNA, 1488 bp, Unknown
  Artificiall/Consensus sequence
atgcagtatgtaagcacaaggaacaaaaaccagaaatacagtgcggcacaagccattgcccaaggcttggcctcagatggcgggctgttgacgccggaggtgcttccaaagctctcccacagcgggttgaacaccatgaccgacatgtcttaccagcaaagagctgtttttgtcatgagctcctatctggatgatttcaccgcttcagagctctcttccttttctgctaaggcgtatgggaaggataaatttgatgtaaaagatgtggctccagtccgaacagtggacgatcacacttactgtctggagttgtggcatggccctacctgcgcttttaaggacatggcgctccagatgctcccccacctgctctccgccgctttagtaaaaaatgaggagcagaaaacggtctgtatcctggtagccacctctggcgataccggaaaagctgccttagagggcttccgtgatgtagacaagacccgtattcttgttttctatcccaaagatggtgtctcggacatccaaaagcttcaaatgcagactcaagagggggataacgtaggcgtctgcgccgtggagggcaactttgatgacgctcagaccggcgtaaaaaagcttttctctgacgctgcccttcgtgaaaccctagccggaaggggctactttttctcctctgccaactccatcaactgggggcggattctgccacagatcgtttactatgtctctgcctactgtgatcttcttcgagatgggcggcttcagagcggagacccgatcaatatctgtgtacctaccggcaactttggcaacattttatcggcctattatgcaaaacagatgggagtgccggtgaaccggctgatttgtgcgtccaaccagaataatgtcctcacggattttatccagacgggaatctacgaccggaaccgccccttctacaacaccatgtctccttctatggatatcctgatctcttcaaatctggagcggatgctcttcgagtttacagagcgggacgatgaagcagtgaagagttatatggatgccttgtcggcggagggccgctatgaggtaagtgagaaggtaaagaagagcctggaccggaactttgccgccggatattgcagcgaccaggatacacaggccatgatttctaatatgtggaagtcccacaattatctcatcgatacccataccgcagtggctttccatgtgttggagcagtaccggatcgagaccggtgaccagactccgtccctggttgtctccacggccagtcctttcaagttctgtgacagcgttctgaacgccctgggagtcagaaatctggaccaggggctcgggattattgaccagctttcccagtacactggtgtgtcggccccagcacctctggagaacctgaaggggaaagcggtccgcttcgaccaagtaactgacaaggagcatatggcggaccgggtattggaaattttgaaataa

SEQ ID NO: 2206 - DNA, 1338 bp, Unknown
  Artificiall/Consensus sequence
atgggttataaaattctgatagctgatgatgaagaccttatcgtccagctcattgcggatgagttccggcagatggggcatacggtctatactgcgctagacggcaagcaggctctggagttatatgataagtttttacccgatattgcaattttagatgtgcgaatgccgggatatactggccttcagtgcctccaagagatcagacaggctaatccaggctttcctgtcattatcatgacggcctacaacagtgtgtccaatgcagtggaggctatgaagtatggagccagtgactacataggaaaaccattcgatgtagccgatcttgtcggtaaagcagatgccctcctagaaaccaaacgtttgcgtcatggaagtggacagaattcgtttggtgacgttatcggagtaagtaatcacattgaaaagtgccgtagcattatcgaaaaagtgaaaaatagccccgtgaccgtcctactcacgggcgagagcgggaccgggaaaacaatgcttgccaaagaaattcactccaagggcagacgtgctgaaaaaccatttatccatgtagactgtgcctccttgccagaaaatcttattgaagatgaactatttggacatgaaaggggcgcttttactggcgccgtggcggtaaaaaagggaaaattcgagttggccggtgatggtgacatctttctggatgagatcggcaccatgccaatctccctacaggcaaaactacttaacgtaattcaggaacgttgtttctaccgcattggaggtactacgcccatccatgtagcctccaggattttggctgcgaccaatgaggacctggaaactgcggtaagagagaaacggttccgggcagatcttttttatcgtctgagcgtggtcgagctgcaatgtttacccctgcgttaccgcagggacgatatccgccctatggcggaacgcttttttcggttctactgggagaaaaaccgggacgaaccgtttggtggtgtggatgaagaggtgtacagtatcttttctggttatgactggccaggaaatgtgcgagagttagagaataccattgagagcattgtggttcttagtgaggggtgccccatcactatacatgatttacccaagaagctcaccagccgcttctccgctgtcttcggcacctcttcagagccagaggacggactctctctcaaggagcgggagattatgcatattatcgaagtgttggagaagaacggcggcaaccgtactgtcgctgcaaaagaattgggtatctccaggcgaagcctacaatacaagctaaaagcccttaagcagcccgaatag

SEQ ID NO: 2207 - DNA, 1548 bp, Unknown
  Artificiall/Consensus sequence
gtcttgggtatccaggacaaccttcaatatgcctaccgtacagcttcctctgacccggcaatggccacaataccagccgatccctcagtggccacatactttaccagcgagctctaccatgtccccctgtcgccctctgcttataatatggagcagtttatgaccgcaactgcccgcaatctggtgaaaaatcagagcagcatcaacggctttggtgtaatgttcgagccgtaccagctcatgggcagcattcctgcctacggtttctttgtagataagcagaacatgagtgcccagatagagccctataccagttatgatgactacgccaaagaatactcctacaaggaggttatcagcagtggtaagacctacctctcccagccttatgagaccagtagcggtctggtggtagcctatggcatccctattaccaatgacggcaaagtggttggagtagcgatctcccagattgagctaagtaatttttcttctttgaatacatccagtcagaattatgatactatgtgggtgacggtcacagacagtcaggccaatatcatctgggacagcgaaaccctggatgatgtgggcaaaaatattattcaagattacatctcgagtgcttccgaacgggaagagctctccaatagccttgcccaaggtgtacctttttccatcgagaacacccggcccaacgggataaaaaccaccgtctactacaccccgatcaccattggggacgatgtctggtggtcttctaccggtatctatacctccgatgcccgggcatcaattgtcagcacaacggtttttatgtctgtaatctctctggtttctctggcggtaattgtcttggtgctgattactgtcattcgccgcaggctcaaacccttgaatcgcttggtagaggccgccgatgccattgcggagggcaatctgaacacccagctagacatccaaacgaatgatgagattggccaattggcccatgcctttactcggatggcacagcagttcaatgacatgatcaaagacattgactatttactctctgaaatgagcgacagaaatttccaggtgtatcccaggagggagacccgctatgtgggctcctaccacagcctgttgctgtccgtgcggaaaatcaaccgctctctaagtgataccctctatcaaatcaatgcggcggcggaacaggtgtcctccggcgcagagcaggtgtccaccggctcccaggcactggcacagggtgccacagaacaggccagcgccgtggaggagctgtccgccaccattagtgatatgggccgcaaggcacaggaaaatgtgaacgccgctcggtcggccaaagagcagtccagccaggcatcggaacaagtttccgtcagcactgctcgcatggttgagatgcgcaaagctatgtctgacatcatggccgggcaagaagatatcggaaagattatcggaaccattgaggacattgcgttccagactaacatcctggcattgaacgccgctgtggaggcagccagggccggggccgca

SEQ ID NO: 2208 - DNA, 1197 bp, Unknown
  Artificiall/Consensus sequence
atgtctattaccatcgcgcttgccggtaatcctaactgcggtaagaccaccatgttcaacgccctgaccggtgcggcccagtttgtagggaactggccaggcgtcacggtggagaaaaaggaaggccgcctcaaaggtcaaaaggatgtcactgtcatggacctgcctggcatctattccctatctccttatactctggaggaagtggtcgccaggaactacttgacccatgagaagccagacgccattctcaacctagtagatgccacaaatattgaacgcaacctctacctgaccactcagcttctggaattgggttaccctgtcgtaattgccttaaatatgattgacgtagtcaaaaagaatggtgataaaatcgacctcaccaagctttcagccgccttgggctgccctgtaatggaaacttccgcaatcaagggtgagggctgcctcgctgcagcacaaaaggccgccgagctggcccaggcaaagcagaaggctgttcctcaacacgccttttccgatagcgttgagcaggccctttctgctatagctgacacggtccgggatgttgtgccccaggatgccgcccggtggttctctatcaagcttttcgaacgggacgagaaggtaatggagcagttcactttctcatccgacgtgaaaaaccggttggaggagatcatccagggctgtgagagtgcgctggatgacgatagcgaatccatcattaccaacgagcgttatgagtacatcaccaaagtggtcggacgatgcgtaaaaaagaatcgcaccggcataagcacctctgacaagatcgaccgcattgtcactcaccggattctggccttgcccatttttgcagtggttatgctcctcatctattccatcgccatgggaacctcccccgccgctctcatcgatggcagcgctgccgagggcgaggcttggggcataggcatcggtactctgggtactgactgtgccaatgacacccttttcggtgagattgttcctggcttctttgacagcttcctcctcaatgcctctggtgagcccgtagtggccgaatggctatatggcctgatccaggatggcattgtggccggagtcggcgccgtcctgggctttgtgcctcagatgctggtccttttcttcctgctatgtatcctggaggacatcggctatatggcccgc

SEQ ID NO: 2209 - DNA, 1425 bp, Unknown
  Artificiall/Consensus sequence
gagatggatatggtgaacaaggcgttcatcgagatcatgattgaaggggatgccaacggccggggttttcaataccccattccaacctactccatcacccgggactttgactggggtgagacggagaataacaggcttctttttgagatgactgcgaaatacggcactccctacttctctaactatatcaactccgacatggagccttccgacgtgcgcagcatgtgttgccgtctgcgtctggacctgcgggagttgcggaagaaatccggcggcttcttcggttccggcgagtccactggatctattggcgtagtcaccataaatctgcccaggatagcctaccaagcctcagacaaggacgacttttacaagcggctagaccggctgatggatcttgcagcccggtccttgaagaccaagcgaaccgttatcaccaagctgctggaggcgggactttatccctataccaagcgctatctgggcagttttggcaaccacttctccaccatcgggctcatcggtatgaacgaggtgggcctgaatgccaaatggctccgcgctgacctgactcacccatctgtccagtcctttgctaaagatgtgcttaaccatatgcgagagcgcctgagcgactaccaggaacagtatggtgacctctataacctggaggctacccctgctgagtctaccacctaccgcttcgccaagcacgacaaggagcagtttccccacatcatcaccgctaacgagaatggtactccttattacaccaactcctctcatctgcctgttggctatacggaggacatcttctctgccctggacatccaggacgggctccagactctgtacacctccggcacagtattccacgcctttttgggtgaaaagctgccctcctggcaggctgccgccgccttggtacggaaaatcgctgaaaattataagctgccctactacacactttctccaacctattctatttgcaaagaccacggctatcttaccggcgagcagtatacctgcccggtctgtggggcgggaactgaggtatatagccgcatcaccggctactaccgcccggtccagaattggaatgaaggaaaactccaggaatttacggaccggaaagtctatgagccctcctgttcccgcctacaccgctctgttgtcttcaaagacccggcagcgggccagggagcggacggactatccgcctcatcttctggcctgttgctgttcaccactcgtacctgcccgaactgccggcaggcggagctcctgctccataaggccgctctttcttttacaaagatcgtggcggaggagtcccctgagctggccagccggtataatatccgccaggcgccaacccttgtgttgtctgacacatctgagccattgaagatattcggccttggg

SEQ ID NO: 2210 - DNA, 1569 bp, Unknown
  Artificiall/Consensus sequence
atgtcaagacccaatgcagcaaagggaggcggtagcttggaacagccgtatgccattgaaatgctccatatcacaaagcggttccccggcatcgttgccaacgatgacatcacccttcagctccggaagggcgaaattcacgccctcctgggcgaaaacggcgctggtaagtccacgctgatgagcgtgctcttcggcctgtatcaccccgaggaaggaaccatcaaaaaggatggaaaggaggtccaaatcagggaccccaatgacgccaatgatttaggcatcggcatggtccatcagcacttcaagctggtagagtgcttcaccatcttggataacatcatccttggagtggagccctgccgtcacggttttctccaaaaagccgacgcccgtcaaaaggtactggacctctcggaaaagtacggattgaaggtggacccggatgccttggtggaggatgtcaccgtaggtatgcagcagcgcaccgagatcttgaaaatgctctaccgggacaatgaaattttgatctttgacgagcccacagctgtactgacgccccaggaaatcgaggagctcatgcagatcatgcacagcttggccgccgagggcaagagcatcctctttatttcccacaaactcaatgagattatggaggtggccgaccgctgcaccgttctgcggaagggcaaatatgtcggcaccgtagatgtgaaggacaccaccaaggaggccctctcccggatgatggtgggccgggacgtggaattcgtggtccacaaggagcccccgaatcccaaggatgtcattttagaggtagagggccttaccgtggcctccaagcttcacagcaacaacgctgtccggggtgtctccttctctgtccgtgcgggagagatcgtctgcatcgccggcatcgacggcaatggccagaccgagctggtctacggccttaccgggttggagcctgtcaaggagggccgtgttctattgaatggccaggatatcacccgggctcctatccggcagcgctccaccagcggcataagccacatccccgaggaccggcacaagcacggcctggtgctggactacaccttagaggacaacatggtgctccagcggtatttcgagccccagtttgtctcttccactggctttctgaaacgaaaggccatccgggagtatgctgtccggctcattgagcagtacgatgtccgctctggccagggacccgtcaccattgcccggagcatgtccggcggcaaccagcagaaggccatcgtggcccgtgagatcgacaaggaccccgatcttctcatcgccgtccagcccacccggggcctggatgtgggcgccatcgagtacatccaccgccagatcgtggcccagcgggatgccggcaagggcgttctgctggtgagcttggagctggatgaggtcatggcgctttccgaccgcatcctagtgatgtatgagggagagatcgtgggtgagctggaccccaagaccaccacggtagaagagatgggcctctacatggcaggcgccaagagaaagggggcataa

SEQ ID NO: 2211 - DNA, 1338 bp, Unknown
  Artificiall/Consensus sequence
accgtacaggagggtgacctgcttttccgtatcgactctaccgatgtagagaccgcaatccagcaggcccagctcagcctggagagcgcccggctcaactatcagcagctcttgaaaaatcaggaggacaacctgaaaaacgccacagtaaaggccacagctaccggcgtgatcaccgagctctatgtggaggaaggagatattctctctgccggctcccccattgcggacatcctggacagagaaaatatgaagctggtggtccccttccacgccgctgatgccgccggcttctacctgggccaagccgcctcagtgactgtggaagggaccctggagaccatttccggcaccattgattccatcgccgcgaccgattctgtgggggctggcggcacactggtgcgcgaggtcaccatcctggtacgcaaccccggtgccctcactgatacctctcagggcaccgctgctgtggggagtgcttccagcgccgccagcggtacctttgagtacggcgagagcaagcaggtagtggccaaaacctcaggagagctcaccaacctcaccgtccgggagggggaccgagtgaccaaggaccaggtgatgggagcattcgacaccactgatatggatacccagatcgaaaatgccgcgatccaggtccaaaatgctgagctcaccctgaaaaatgcccaggacagcttggaggactatgctattacatctacaatcgatggcactgtcatcgaaaaaaactatgacgtgggtgacactctcgacacctccaacgccaataccaccggcatcgcttatcccgctgtcatctatgatatgtccgccctcacctttgatgtgagcatcaatgaactggacatcaacaagattcaggtgggccagaaggtagagatcaccgccgacgccctggatggccagagcttcacaggtaccgtggacaaggtgaacatcaacggtaccaccaccaacggcactaccaactatcccgtcaccgttctggtggacggcacccccgaggaactcaagccaggcatgaatgtctcggccaagattattgtggaggatgttggctcggtgctctgtgtccccgtggaggcagtgagccgtgggcaaaacggtgcaagtatggtgacggtggccggcccgggcgccctggatgagcagggcaatgtgatcgatcccactaagctggagcagagagaggtcactgtcggccgcaacgacagcacccatatcgaaatcctctccggcctggaggagggcgagacggtctacatctaccagtctgtgggttccaacatgatggacatgatggtggggtga

SEQ ID NO: 2212 - DNA, 927 bp, Unknown
  Artificiall/Consensus sequence
atggcagaagttttatcgcaaagccaaatcgacgccttgttaagtgcggcccgcagcggcgagatggatttgtcagcttcggcggaaaagaaaacggaaaagaaataccggaaatacgatttcaaaagcccgagaaaattcaccaaagaccggctgaagatgatcagcagtgttttcgaaaattatactagggtggtcaactccaggatcaacggcctccttcacaccacctgtgaggttacagtggagtcagtggaggagcagcggtattacgagttctccaatgctctgtcggagggagacgtattggccctggcggatgtgaagctggaggggcaggaccacccggaggagccgccagtactgctccatttcagtaccactttgatgttgagtatgatggaccggctgatggggggagacggggagctcgaatccggtctaccagatggctacacctttaccgacctggagctgcggctgtatgaaagtattgtaagggatatggtctctgttctgggcggaagctgggagaactacatcgatctggagtttggcttccatcgcattgagaccaaccctactttggtacaactcattggtctggatgagacagtggtcatcatcggtatcagctttaaattttccaactgttccggccagatgaatatttgcttgcccggcttggtgctcaccaacatctttggccggatcactgcttccaaccaggctggccgaggtacaggggaggaccactcgggggaaattttggatatcctacgggattccgagctggagatttccgccgagctgggacgtacggagctccagctccgggatgtctatttcctcaatgtgggggatgtcatcgacttggggcaccccactggtgaaccggtttacctctatattggcgggaaaccctgg

SEQ ID NO: 2213 - DNA, 1335 bp, Unknown
  Artificiall/Consensus sequence
cggaactacaccaataatacttccgccctgagctccaacctggagaagctctcttccggctacaaaatcaaccgggccggggatgacgccgccggcctggccatttccgaaaagatgcgggcccagatcactggcctggatgtggcccagaaaaacgccaaggacggtatttccctcgtgcagaccgctgaaggtgcgctcaccgaagtccatgatatgcttaaccgcatggtggaactggccagccagtccgccaatggcacctatgacaatgacaccgaccgcgctaatctccaaaaggagatggaccagctactggacgagatcaatcgtatcgctgactcctctaactttaacggcatcaatctgttggatggtaccatggatgccaacgccgacctcactacttatggtaagtttactctgcccgaagtcggccagattctaggtactaatacggtgttgcataatgacgccctgaccgcaggtggcaccgagttctccatcgatttgcataactatacttttagcaatgctaccggcgagactctatcaattgaagtgggtggcacaaaatttgaactggccggcgatggcagtggtgagttagacgccacagggattatcgggaagattgtggacggcacagctactgtaaacggcactgcgcctgtcacccccggcacagtccagatcaacggccaggacttcacggtggaagacagcggaaatggccgtctgacttttaagcaggtcaaagcccccaccactgcggctgaggaggtcaatggttccatgaaggtcaccatctccggtgcggggactgctggcacagctgctactggggcgactgtgactagcaccatgaccggcgcaactggtaccgccgatgctaacgataccatttcttttacgagcactggtggtacgactaacctatccctcactgcgacctttgatggcaccaactggactgtcgccggtgctcctgccggctggactgcaacctttgacggtaccgatttggtgctcaccagtgatgcgactggctcgggtaccgctgatcctgatgtgggcacgattacggcgactgctggtgtcggcaacactggtaacttcgcagttggtacaatggctgctgcggcctttgcggacggtactgacgctgtcgccggcggtcctgcttctggcacgggtgactacaatgtttccaccaccgacatcaccaatgtgactgcaggtggcaccgaccgactagccagcacctacttcgagctgaccaaggatatgataaccgacggttccaccatcactatcggtaattctacctatacc

SEQ ID NO: 2214 - DNA, 1455 bp, Unknown
  Artificiall/Consensus sequence
atggattttgcatactatattcttatgccgtttacctggctgctccagtttttttataacgtcttcggcagctacggctttgccctgattttctttgccgtcatcgtgaagctgatcctctttcccttttccctgaaggggaagcggagcatgatccagatgaacatgatccagggcaagatgcagcagattcagaggaagtacgccaatgatcgggagcggcagaatctggagattcaaaagctctacgaaaaggagaaggtcaaccccatgagcgggtgcctgtggtcctttgttcctcttctgattctgctgcccctgtacgccatcatccgccagcccctgaagtacatgatggggctcaccggagagcagatcacccagcttctggaggtcctgaatacctactccgccacagccattgatcccacgggcaacgctttctatcagttggcggcgtccaatgtcctcttccagaactttaaggatgtggtggaaaaccccgcagtggcggcttttgcagacaacctcaagcagatcaacttttccttcctggggctggccctggagactatccccacttggcagatctggaagggccctttcacctggaataccattggtaccttccttctccctgtgatctcggctgtgagcggtctgctgttctccgtgatctccatgcggaccaatcagctcaaccggaatcaggagcagactgctcagatgaagagcaccaaccgtaccatgatgatcatgtctcccctgatttccctctgggtaggctattccatgccggcggccatgagtatctattggctggctaacaacctgctctctatgctccaggaatttttggcgggtaagttactgaaaaaggactatgaggccgccgccgccgcccgggcggagcaggaacgtctggagaaagaggaggagaagcagcgccgccgggaggccgccgagcgcaaggcccgcgccattgaggaggccaaggccaaccggggcaagaagaaggccaagcccgccgaggagaagaaaaagagcgatgcctctgtaatcgccgtcagcggtgtgggcatccgggcttatgcccggggccgggcctatgatccttaccgctttagtcctgacggacctactccctaccacgacccaggagctcccatcgtggatgaaaacgcagtggagaaggccctggagaaacggtctgacgagctccaggcggtggcggcagaggcgttggccgacgaactcattgtagaggagattctggagcagtctggcgggaagtcaccggaggatactccggaccaggccgggcaagttcctgccggggaggagacagcctctgctggaggggaggatccctgggaggagattgaccaggaaatccgggacatccagcaggaaggtcctgaggaggacaagccccaggatgcaccaccaacataa

SEQ ID NO: 2215 - DNA, 699 bp, Unknown
  Artificiall/Consensus sequence
gggctggcaatgaaacacacctttggaaagggaaaaaagggaaaagccggcggcggcgcggttcctcccaaaacagtccggggtttttcccccgggcttccagaaaaaagcaggacatatttcggcgggacgggcgcataccatagaacaggaagtgaagagaggagagggaaccccatgccgaagctgtctaaacgcctactgctcgcctttgccatcactacggtggcgggggccggcctgcattttttgtacgacctgctgcccaatcccattaccgccctgatttctcccgtgaatgagagcctgtgggaacacgtcaagattctcttttggccctatctgatagcctttttgctgctgaccaggggcggcgaaccgggaaccaggacgccctggatgctcactgtgcccctgctatgtgccggtatgctggtcttgggatggctctaccatatcgttctggggggagaggccatgtgggtggacatcgccatctatgtggtgctgatggcggctggatttctgctgccggggttcctccaccagacgggggaacgggccctgtggggagacctgggcctggtgctggtactggtcctggcgggactgcttgtgctctttacctttttgcctccggatcatatcctgtttcaggacctttccggggcccggacctgggccaccattccctgttga

SEQ ID NO: 2216 - DNA, 1680 bp, Unknown
  Artificiall/Consensus sequence
ctgatctttgtcctgaaccttttgccggtgctggccatccttttgctcctctacggactgacgggccgggcccagctctcctttggcgtcacggctgccctggtctttggcctctcggccggcaattactataagctcatgttccgcaacgatcccctgatgtttgccgaccttctgctgctgaaggaggcaggggacatggcgggcaaataccatcttttcctggactggaaattgggcctgatgctcttctgcgccctggcagggctgctctttctccactttctggtccggggccgccctgcgggccggggccgcgggctgtgtgccctggccggcatcaccgcctgtaccctgctctacccggtggtgctgaatggcactgtttacgaccaacgcactgcctactatgaccggcttaacaacatctggtcggccacccagcagtatatttcccggggctttgtctatcccttcctccacagcatctccgacgccgtggaggctccgccggagcactacagcgccgccagggcccaggccatcctctccccctatgccgacgccgatatcccccaggaggagaaggtcaacatcatcggcatcatgctggaggcctataacgacttcaccaaattcggcgtgcccaatctggccatggatgtctacgaggtctggcacggcctggaggccgagggctactccggggacttggtgactaacatcttcgccggaggcaccatagacacggagcgctgctttctcaccggcttttccgacttggtgaacttccggacccggacaaactcctatgcctggtattttcgctcccagggctatgccgtggaggggatgcacccgtgttatgagtggttttataaccgggaaaacgtcaatgagagcctgggctttgagaactactactttgtagagaactacttctcccctcttaccaacggcgatgtggccctggacgatgtctttttcccggagcttttgaagacctatcaagctgcggagcagtcggaccagccctatttcagcttttcggttacctatcagggccacggcccctacaataccgatgtctgctggtggggggagaagggcgactatgtggtagaggacggcacctataccgaagagcagcagtatatcctggacaattactttggctctgtctacaacaccaaccagcatctgaaggagctcacggactacctccggactgatgacgagccggtgattctcattctctttggggaccacatgccctggatgggggacggcaattcggtctatgaggctatgggcctgaacctagacctctctacccaggagggcttcttcaactactatgccacccgctatctcatctgggccaatgacgcggccaaggaggccctgggcaccgactttaccggggagggcccggcgctgagccccaactttctgatgagtgaggtcttccgcctctgcggctgggaggggccagcctatatgcaggccgcccggcaggtgatggaccgggttcccgtgatgaacacgcctacgggcctctatctggaaaacgggagcctcactggggagctctcccctgaaggggaggctctggtggaggactacgatatcctgcaatactactaccgcagccattttgtctatgacgatgtggaatga

SEQ ID NO: 2217 - DNA, 1407 bp, Unknown
  Artificiall/Consensus sequence
atgagggacggattttatctcttttttgactttgtgggaatcttctttgttctctacatggtaggctatgccagctttctttttctgtctgttacagtgggttcctcagagctttaccgggccaaacaacggaacctcctgaaaaatgagttgctcaatgattactatgtgcctgtatccatcctagttcccgcccataacgaggaggttaccatcgaggcaaccgtgcggtccttgcttgccctgcactaccggctctatgagattatcgtggtggacgatggttctactgatggcacgacagagaccatgtgccagtcattccagatgcaacgggtgagccgtccaattcagcaacagctctcctgtcagccggtggaagcagtttttgagtgccgggtttacaaggtgcctattaccctcatccgaaagcgcaacggtggaaaggccgacgctttgaacatgggtattaatgcctcacgctatccctatttcctctgtatggatgctgattcggtgctccagagcgactctttggagaagattgtccgccctgtgctggaggatgaccatgtagtggcggtgggaggggcggtacggccctgcaatggcgctcagattaaggacggccgggtggtcaactaccatatgccaaataaagttctggcctgtatgcaggtgctggagtatgagcgttctttcctggccgcccggattctgtttgacaagtttaacggcagcatcatcatttcaggggcttttggcctcttcaaaaagagcgtggtaatcagtgccgggggttacgactccagcacagtgggggaggacatggagctggtggtgaagctccacgtcttttgccgagaaaattatattccttaccgcatccgctacgccaccgacgccatttgctggacccaagtgccggaatctctgggagatctgtgtaagcagcgtcggcgctggcacataggcctctttcagagcatgatgaagcacaggcgtattctggctaatcccagatatggtatggtcagctttatttcttacctttattttctcatttatgagcttctctccccttacatcgaggtattcggggtcctgactatggtgctggcgtggctttttgactttcttaaccttccatttatgctgatatatttgggtatctatgtggcctattccgccattttatccctgaccgcatttttcgcccgggtccacactatcgatttgcggctggaaatttcagatgctttgaaggcggtggggctttgcatattggaggtctcctgtctgcggtttatcctggcttgggtgcggatgacctccctgatgggctaccggaggaaaaagacaagctggggaagcatccagcgcagaaaaattaattataaaccataa

SEQ ID NO: 2218 - DNA, 1083 bp, Unknown
  Artificiall/Consensus sequence
ggaggaagcgcttacgcgctgggagtccagcctggtctagacagctcggtgaaggcagtgacttggttcaaaggctaccgctattatggcggcttccagtatgtccgggatcatggagggaatctggaagtgctgaatgttgtctccttagatgattatgtccgcggtgtgttgccctatgaaatgagtaatgactggccgttggaggcgctgaaggcgcaggcagtctgtgcccggacttatgctgttaccaataccagtgggcatcgggattttgacgtatgcgctacaacccattgccagatgtatcagggcctcaacctgtccaatgagcatacagatcaggcggtggacgaaacagcgggagaatttgtgcgttatcatggagcacctgccattacctattattctgccagtgacggcggcgctactgaggatgtgcggaatatctggaacgcgaacgccaatttgccccatttgaaaggggtcgtggacccctatgaagccgatgtggcagatggcatctcccagtacaattggtcttatacctttactagtagtgagctcaccgctgaaatgaatgatgctctgagtggacggggatactcctttacagagataattaacgtttatgtctcggagtacagtgagacggagaatccaatctccatcacttttgtagaccgcagcggaaagacctggtcctttggtccggagacgatacggattgctctagggttgaggtccaaccgatttgatgtaactggaggggacagcggagggtattctgtcaacgatggctctgaaacgctggcttctgttcgtggggtttacgcgataagcggggagggatctgccgccgcgatcacaggggagccctatgtcatcacctcttctggaacaaaagagctctcagctccaacgacttcttcctcccagggaaatgacagctttactttttccggcgccggaaatggccacaacgttggtatgagccagcagggggccagagcgatggcgttgcggggaatggattacatcgacatcctcaccttctatttctccaatgtggagatttggtga

SEQ ID NO: 2219 - DNA, 1026 bp, Unknown
  Artificiall/Consensus sequence
atggatgaaatcctgcacgcaccacaaaacgaattcccgctccgtagaccgcgcaaagaccacagccccggaggggcagagagggtcgagcgcttcaaggagcggttttccaccttccgggaggagacagccgaccggagccgggtcctccggctccaaggggcccgggtctaccaccgggcttggtcggcggtggctggaaagccaaagctctcccccctgcccttcctggcgctcagcgccgttattggcgtggcggcggtggtgggcacagtctacaccccgtcctatgtggtgacggtagacggcacagatctgggactggttcggaacactagcgtcttcgagcaggcagtgtcccgggtggaacggagggccaccgaaattttgggctatgactaccaactggaacagacggtgaattacacgccagcccttaccaaccgcagcgatattacgccggtggccgattttgagaattacctctttgaccagatcggggagatcacccagggctatgtgctgacggtggatggacagacggtgggcgctgcggtggaccgggccacactggacaccatgctggaggagcttgccgctccatatgtcaatgagaacaccgtctcagtgggttatacgaaaaacctccacattaccaaggagtactttcccacagatacccagcaggacacagccgccatgctcaccaccctcaccgccaacaccaacgggcagaccacctatgaagtccggcagggcgataccttcatggccctagcctttgacaacgggatgagtatggccgaaatggaggccctgaatcccggagtggatgtggaccggctctatatcgggcagatcctcaacatccgggaggaaatccccttcttgggtgtggaaactgtggacgccgtcacctatacggaagagatcgcctgtcccgtccgggaggtagaggacagcagcatgtaccagggagagtccactgtcctggacgccggtgttcccggcgaggccctggtcacc

SEQ ID NO: 2220 - DNA, 1041 bp, Unknown
  Artificiall/Consensus sequence
atgcctaaaaacgacgacaagcgctctgtacgttgctccttttgcggtaagcatcaggaacaggtctcccgaatcatcgcaggtccgggtgcctatatctgcaatgagtgtgtccagctctgtatgagcatcctggaggatgccggaacagatttggaggaagagcacatcgatgtacccgatgtcatccctacccccagggagatccgtgacgttctggaccaatatatcattggccaggatgatgccaagattgccctttctgtggcagtttacaaccattataagcgcatctactttggtggcggggatgatgtagaactccaaaaaagcaatattctgctgatgggacccacgggatgcggcaagacactttttgcccagactctggcccggattttgaaagtgccctttgccattgccgatgccaccactcttaccgaggccggctatgtaggggacgatgtggagaacattcttctgcgtcttgttcaggcagccgactatgacatcgagctggcccagcggggcatcatctatgtagatgagattgacaagatcgcccggaaaagcgagaatacttctattacccgggacgtatctggcgaaggtgtccagcaggctttgttaaagattttggagggtacggtagcgaatgttccgccccagggaggccggaagcatcctcaccaggaatttattcaaattgacaccaagaatatcctatttatctgtggtggtgcctttgacggcattgaaaagattattgagcaacgactcgataaaaaagccatcgggtttggtgccgagattgaaagccgaaagaagcgggatgtatcggcgatcctgagggaaatccagccccatgacttgctgaaatttgggattattccagagttggtaggccgtttgcctgtcatcactgcccttcaatccttggggaaagagcagttggtgcgcatccttactgagcccaagaacgctctggtaaagcagtatcagaagcttctggagtatgacggagtggacctggagtttcag

SEQ ID NO: 2221 - DNA, 1563 bp, Unknown
  Artificiall/Consensus sequence
gcgaatgaggcagctaagagagctgatctggaagaccgggcaaacgagtgtttagacgagctgaacacacgcctgaccgagttgcggagtgtctatccactgaatgacggcaggatagacgaatacgtgacagccgtcaacgactggggaaatatgatccccgacatcttatctgcgatcgatgcaggcagaatggaggaggccacccggctcattacggaggagtgctccccacgtcttaccacgatgtcgtctatcgcaatggaaatcgatgacgccctggccgatgcgcaggacaaggctaccagcgctcagcagaataccagtactatcgccatgattgtgattatcctggtaatggtggtggcgaccatcatagtattggccctggcatttcggatcatcaggaatatcattgcgcccacgacccaggtccgggatgccctggtgggctttagcgaggggaacctggatatctctgtggagttcgagagcaaaaatgagctgggtgatatgtgcgaggccctgcgcaccagccagcatgtgctgtccagcgtcattaaggacgaatgccgcctactggaagaaatggcacatggaaactttaacgtgaagagtgatgtcagagagctatatgtgggcgctctgggcggggtgcttcagtccattcgagtcattaacggcaatcttagtgataccctggcccagattagacagggggctgagcaggtggctgccggcgcggaccaggtctccacgggcgcccaggggctggcccagggtgctactgagcaggccagcgcggtagaggagctctccgccaccattagtgagattgacaatagcgcccggagcaacctgaagcttgccgaaacagcccaggagaagtcccatgaggccgctggccaggtagaggtctgtaacggcaagatgcaggagatggagcaggccatgagcgatatcctgtctggacagcaggatatcagcaagattatcgcaaccatagagaatatcgcgttccagacaaacatcctggccctgaacgctgcggtggaggctgcccgggcaggaactgcaggcaaggggtttgcagtggtggccgacgaggggcggaacctggcttccaagtcggatcaggctgccaagcagaccaaaaagctcattgaggattccatgtcctttgtggagcggggcagccaactggtgtccgacgcagtgaagagcatggaacagacggtggaaggcgccggagtggctatctcctatatggagcagctggccaagagctctgtcgcccaggctgacgccatcgctcagctcaccactggtgtggaccagatctctgccgtagtccagaccaactcggccaccagtgaagagtccgctgcggccagcgaggagctctcctcccaggcggtggttatgaagcagatggttgaaaaattccggttgcgcgaggaccagattgtggaagccgctccgccagttgagaaggcttcgggcacttcttccgtatacagcagtgcagaaagaagtgacgagagcgtttttagtaagtattga

SEQ ID NO: 2222 - DNA, 945 bp, Unknown
  Artificiall/Consensus sequence
ggcgagtacattgacgagtcagtactggatgactttgaggaggccacaggcatcaaggtcaactatcagtattacgacagcaacgaaaccatgtactccatgctgtccggcggcggcgcggagtacgatgtgatcatcccctctgactatatgatcgcccgcctgatctcggaagacatgctggagcccctgaacttcgacaacatccccaatttttccgacattgaccccgagctgaaaaatccggagtacgacccagagaacctctattctgtgccctatatgtggggactcatgggggtcatctacaacaccaccatggtggacgaggccgacctgggaagctgggaccttctctggaacgagaagtacgccgacgatatcgtgatgatcgacaactcccgtgacgccattggcatcgccctcaaatccctgggctactcttttaataccaccgatgcgtctcaaatcgttgaggcagtggacctgctcatccagcagcgtcccattctccaaggctatgtcatggacgagattttcggtaaaatggaggcctctaacgctgctatcggcacctactactatggtgactacctgaccatgctggagtctaactctgatttaggcttctatctccccgaagagggcaccaacatctatgtggatgccatgtgcatccctaagggagctgccaacaaggaaaacgccgaagccttcatcaattttatgtgctccactgaaaccgggttgaaaaattgcgaggaaatctggtactccactccgctgctctctgttcgggatgctctggacccggaggtctcctccgatccctacgcttaccctgactctgatatcttggctaagtgcgagagttatgctggattacctcagaatatcctggacctgtatgacagcgagtggacccgtctgaagtcctctggctga

SEQ ID NO: 2223 - DNA, 1113 bp, Unknown
  Artificiall/Consensus sequence
accagcctgggcaacgggatgcagaactatatgaaccagcagtttgaccagttgggcgccaacctcattcaagtccagatctggggcctgggaggcatgagctcacgctccgtggacccagatgacatgtacgcactggtagacaagtatccccagtatctagcgggagtgagcccctatgtcatgacgcaggggctggtacgccgtggcgccgacgatttcgaacgcaccagcgtctatggcgtcagcgagtttttctatgacgctcagcgcaaccaggtcctcagcggctctcagctaggccagggccgttttttgagctacatcgatgtggagcgctaccaaaatgtctgtgtcattggcagctatctcgaccaagctgcctttggcggcgactccctggggcggtccctgaccatcaacggcactcccttcaccgtcatcggtgtcatggccgagtacgctgacagcaccgagggcagctctgacgatgtcattttcatcccttacggcaatgccatgcagctcaacggttccggctgggtggacctctaccttttcaacagtgccgacaaggataccgccaatctggccaagggaatcattgagagccgtctctatcagaccttccagaccgaggatgcctactatgcaatgtccagcgctgagatgatggacgccatggacgccatgctcaacactttgatgatgatcctcatcctcatcgctgccatttctctgctggtaggcggcatcggaattatgaacatcatgctggtctcggtcacagagcgcacccgggaaattggcatccgcaagtccctgggggccaagcgccgggacatccgcagccagttcatcattgaagcgggcactacctcggccattggcggagccatcggtatcgtactgggcatcctcatggccaacgtgctcaccaatgtcatcgcatttgccctgggcaccggtaacgacggctttgtggccgtccccaccttggggggcattgccgtctccttcggcgtctccgttggagtgggcatcctcttcggctacctccccgccaacaaggccgcccggctcaaccccatcgacgccctgcggtatgattaa

SEQ ID NO: 2224 - DNA, 1041 bp, Unknown
  Artificiall/Consensus sequence
acggatcagtccatgtccatggacatggaccagttcaacctgaagggagagaaggagctgctgaagggtgccggctctctgagtgaagcaacaacggatattttggctttgagcgatgttctgaaggacaaccaggcagacctgggatactcagataaatttgtctccgaggactttggagcccgccggcagtatttgatggctagtaaggctgaggcaagagaccgcttgcgggagatcacgggtgagaatgaaaaaggtagtaccgcccaaaaagccagctccaagattgcttttggagagaccggccagaaccaggggttccaggacttcaaagggcgctatgtgaactcgaaacgggagcagacccggttggagactggcaggaagtacaacaggatatccaatgaccactatcaggccgccacgccggagcagagaaatgcagggaaggcatacatccaggattcccgcgacgtgaatgggatgctgcggggaatcaccacagagaccggagagcggaaggagactctgcagaaaatggcagacaatctcagcggcatgatgcaaactacggagagcgatcagaagagctaccgtggcatctccgatgcagggctgttgcccttgttgacacaggcggggatggaggatgtgatcaagcccaacggcacagtagaccacgaggctttgatacggcagaaagaacggctcatcggcatgacttatcaggacaaggggttcagcagcaccactgcctcccagcagttcgccctagattggggggaacggctacccagcagagacctgaactttttcaagcagcgggccctggaacgccacggagtatcgcaggaggagcacgatgccgaggaaaataaggacctttttgacatgttggaggggcctgataaagagaggctgaccgtcaagacccggcaacaggtttacggccttttggcagacaatattttgaaaggggacgagacggttaaggagtctgatatcggctcccatcttatggaaatcgctatgccaaag

SEQ ID NO: 2225 - DNA, 1557 bp, Unknown
  Artificiall/Consensus sequence
atgtccaaaaaacccattctcacagcggacgaggccgcttcctgggtcaaggacggcgacaccatcactaccagcggctttgtggccagcggaatgcccgaggcccttaccaaagcactggagcaacgctttctgaagaccggctcccccaaaaacctgaccctctactacgccgctgcccaaggcaaccgggacggcagtggcgctgatcactttgctcatgaggggatgctcaaacgggttattggcggccactacaatatggtcccacagttaggcaagctcattacagagaacaagctggaagcctataacttgccccagggcaccctatcccagctctatcgggacattgccgcccacaaacttggcaccctcacccatgttggcatgaatacgtttgctgacccccgtatcgagggcggaaagctcaacaacatcaccaccgaagacattgtggaggtggtggatgtcttgggagaagagcgtctcctctacaaggcccagaaatttgacatcggctttatccgtggctcttacgccgacgagaacggcaacgtgaccctggagcatgagtgcgccactaccgaggcgacctctatcgcccaggccgtaaagaactgcggcggtaaagttgttgtccaggtagagaaggtggtgcaggacggatgcgtggaccccaagctggtgaagattcctggcatctatgtggatgcccttgtgatctgcgaggacaaggaggatcacgcccagtgtcaaggctgcgagtatgacggctctatgaccggcgacttccgggtgcccctcggcagtctggcttatccgcccatgagcgcgaagaagatcatcggccgccgtgcggccatggagctagagcccgacaaggtagtcaacctgggcatcggcatccctgagtacatctctatggtggccaatgaggaaggcattggcgactacatgaccctcacagtagaggccggtcctgtgggcggcattccgcagggtgggccaaaattcggcggctctgttaacgtggaagcgattctggatcagccatatcagttcgatttttacgatggcggcggtgtagacttggctttcctgggcttggcccaagccgacaaggacggcaacatcaatgtctccaagttcgggcctcgcatcgctggctgcggtggcttcgtcaacattacccagaacgccaagaaagtatttttctgcggcaccttcacggccggcggcatcaaaacccatgtagaagatggaaagctgtttattgaccaggagggcaaggagcagaagatgatcgacactgtggagcagattaccttctctggagcctatgccaataagacccgccagcctgttatgtacatcaccgagcgcgccgtattcgagctgcggcccgacggcgtctaccttaccgaagtggctccgggcattgacgtccagacccaagtgctggatatgatgggctttacccctaaactggaagagggcggtcccaagacgatggatgcccggatctttgccgacggcctcatgggactgaagtaa

SEQ ID NO: 2226 - DNA, 1194 bp, Unknown
  Artificiall/Consensus sequence
atggaagaaaaaataacggctgcccctgttgcgccaaaaccaaaaaaaccactgcccaagtccaggatcatggtcagtgagcagttggcacagctctatcaggacaccatcgacgccaaggcccgcggggaaaaaatcggctggtcggcctccattttcccccaggagatcgcagaggctctgggcctgtacatcgtctacccggaaaaccaggccgctggcctggctgcccgtcaccaatctgagccactcctcaaccacgcagaggccctgggctacaacatggacatttgctcttacgccagaaccagcttggcctacatggacacgctgaaggccgagagcaacaatatgcccaaacccgactttgtcctctgctgcaacaacatatgcaaccagctcaccaaatggtttgagaatctggcccatgagtttcatgtgcccatgttcctcatcgacaccgtgtataactacgactcctgcgcctcggaggaaaaggtcagatatgtccgcagtcagatcgatgacctcatccgtggcctggaggagatctccggccggaagctggaccccaaacggctggaggaggttatgcgcatctccctgcgaaataaagatctctggcgggaggccaatgagctcctggccgcccggccggcgccgctggcgggctttgacctcttcaactatatgtcctgcatggtgtgcaaccggggcaaggccagcaccaccgccgtgctggagcagctcatctcggagatcaaggagaacattgcccagggcaagagcaccttccctgtggaggaggagtaccgcgtcttttgggagggcatcgcctgctggccttacctggggcacaccttcaagaccctgaaaaaatatgggatcaacatggtggccaccggctatgtcaacgcctggggcctggactatgagctgggtgacctggacggcctggccagagcctacatcgacttgcccaacaacaataacaacctggagaccgtggtggagcgccggatcgaggcccacaagaagttccaggtggacggcaccatctaccatgtcaaccgaagctgcaaagtcatggattgccagcagtacgaaacccagcggcggatttcggaggccacaggcatcccctatacctcctttgatggggatcaggcggacttccgggcctacagcgaggcc

SEQ ID NO: 2227 - DNA, 1740 bp, Unknown
  Artificiall/Consensus sequence
atgaaacgtattggattttggagcattacgctcattgccatcctggtagttttgtgctgcgccaccactgccctggcttgcacggtcgttgcagttggtaaggaagcctctgctgatggttccaccatggttacccatagctgcgatggttggtacgatcatcgggtcgttgtggttcccggcggcacccacgccgaaggcgaaatggtagatatctatcgggatccttgccaggataccatggtcacccccgagaagttcggtgaggttcctcaggttgctgaaacctatacctacttcaacgtggcctaccccttcatgaatgaaaagggcgtcctgatcggcgagcacacctggacgggcattgacgacgtgtacaatcccgaaggcatgttcgtgatcgccaacctggagatgctgggcctgcagcgtggttccaccgcccgcgaggtggtgcagatcatgggcgatctggctgagcagtatggctacggcgatggcggcgaaatgctggccgttaccgatgccaacgagatctggatctttgagatcgtcggccccggcatgctgtggacccctgagagcggcacccccggcgcccactgggctgcccgccgccttgcggatgacgaagtgttcgttggcgccaaccgctcccgcctgggcgtgatcgacttcaacgacaccgagaacttcatgtggtccgaaggcatcaccgacctgcccgagcagatgggttggtggtccgagggcgaagacttcgacttctccaagatctttgaccgcgaccgtaccggccaattcggctcctctcgccgtgagtggcgggccttcgacctgctggctccctctctggagctccccatcatcgatggcgccagccagtatgacttctccatcaagcccgacgagaaggtgaccatggacgacctgttcaccatctataacgatcacctggagggcaccccctacgatcagaccgtcggcgtagcggctggcccctatggcaaccccaaccgcaacagcatcaagagcgagcagatccccgagagcgcccagggctacggcttcgagcgtaagatcgccatccacacctgctcctatgtgttcatcggccaggcccgcggctggctgcccgctgagatcggcaccaagctctggtacggcgcggatgatcccagcaccacctgctacgtgcccatctatgccggcgtgaccgaagtccccgaggcttggtccatcggcgaccgccgcgctttcgatcaggatagcgcttggtgggcattcaacttcgtgaacaactgggcgcagctgcgttgggacgccatgtatgaagagatccacgcggagcgggccaagtacatggatcagttcatggcggaagaggccgacatcgacgccgaagccgccaagctctatgaggagagccctgaaaaggccgtcgctttcctgaccgagtacaccaacaacgccatgaataccgtctacgaaggctggtgggatttcgcttggagactggtaggcaagtactatgacggcctgtgcctggaagaggacggctcccgtaccaccctgggcatgaccaaccccgactttgtagctgcctctggcattggcgagaccatgatcgcggatatggaagccatctatggtaccaccaccgaggaagaggcccccgcggaggaagcgccggcagaagaggcccccgcagctacggaagctcccgctgaggaggctcct

SEQ ID NO: 2228 - DNA, 2031 bp, Unknown; identical to SEQ ID NO: 2079
  Artificiall/Consensus sequence

SEQ ID NO: 2229 - DNA, 1110 bp, Unknown
  Artificiall/Consensus sequence
atgcggtttaccatcgacacccaggagctcaacagcggcatcaataccgttatcaaagccatcggcaacaggaccaccatcagcatattggagggcatctatctggaagccacctttaacggcctgctgctgcgctgcacagacctgtccctacagatcgaaaccatcctgcccgcccacgtatcccaggaaggggcctgcgtgatgccggggcggctgttcagcgaattggcgcggcggctgcctggggaagagacggagatctataccgaggaaaatacggtatacatcagcagcggccgggcccgcaccaatatgcaaagcgaaaaccccggggaattccactgtatgcccccggtaaaggaggaatatgcggtctccatctcccagggcaccttcaagagcatgatccggcaatgcattttcgcctccgcccaggatgaaagcaagcccatcctcaccggcgtattgctggaaatgcggccggaaagcctgcgcatggtagccctggacggctaccggctggccctgcggcaggaacccctgctctccggccgggaggataaggacgcggtgatccccgccagaagcctgatggaaatcggccgtatgctggaagaccgggaggatcttctgaaggtgatcttctccgccacccatgtgatgatcgatatgggccataccaaggtgaccacccggctgctggacggggaattcatccgttaccggcagatccttcccgacggccagaccacccgggcccaggtggaccggcaggaattattggacagcatcgagcgggtatccctcatggcccgggagggtaaaaagaaccacatccgcttctccttccagccggaatgcctgaccctttccgccaatagcgagatcggcttctccaccgaggagatcgccatcaacctgaccggcaatcccttggatatcgcctttaacgcccggtatttttccgatgtgctcaaggccctggaggacgaagccctcatgctggatatgaacaacaacatcagcccctgcgtggtgcgccccctccagggggaccggttctattacctggtgctgcctgtgcgcctctttaccgggaatatgtaa

SEQ ID NO: 2230 - DNA, 897 bp, Unknown; identical to SEQ ID NO: 2098
  Artificiall/Consensus sequence

SEQ ID NO: 2231 - DNA, 1365 bp, Unknown
  Artificiall/Consensus sequence
atgaacgggcgcaagaccgccctggtgtgcggcatggcgaaaagcggcgtggccagtgcgcggctgctatgggaacagggctaccaggtcaccatcaacgacatgaaaaaggagatcccgggtctaaaggaacagctggcgggcatagagtatagggacgccctgggtcaggaccccatggagctggtagcggggcaggacctggtggtcctaagcccggtgatccctattttcgccccctttgccaagaaggccaaggccctgggggcggaggtgatcggcgagatcgagctgggctaccggtattgtgacccgaaggcccggtttgtctgcgtgagcggcaccaatgggaaaaccaccaccaccgccctgaccggcgccctattccagggggcggggaagcgcgcctttgtgctgggcaacatcggggtgcccatcacccaggaggccaagaacacccggcctggggactacgtggtagcggaggtggcggctttgcagctggagagcataaagcggttccggcccaacgccatggggatgctgaacatcagcgaggaccatctcaaccggtttgagaaccggatggaaaactatgtggcggccaagtgccgggcctttgaaaaccagcggccggaggacttcgccgtgctcaattacgacgacccggtggtgcgggatatggcccggctcaccaaggcccgggtggtatatttttcccaggcccaggcgttgggggaaggcatgtgcctacaggacgggcgtatgaccttccggctggacggccgggagatccccctggtccggcccggggaattgcagatccccggggcccacaatttggaaaacgccatgtgcgccgccaccttggccctttgcatgggcctggagccggcggcggtttgtaggggcctaaaagccttccccggggtggagcaccggatcgaattcgtccgggaggtggggggcgtgcggtatatcaacgactccaagggcaccaacccggattccaccatcaaggcggtattggccatggaccggcctacggttttgctgctgggggtgggcaactacgacaagcatagcgattttcggcccctgttcgaagccttcgggggccgggtgaaggcggtgctggcctccggctgcaacattccggccatccaaaaggcggcggcggaaaccggcttcaccccgttttatacctatgacggcccggattttgaaggcatgatccgccgggccggggaattggcggcccccggggatacggtgctgctatccccggcggcggccagctggggccagtttgacaactatgagcagcggggcgaaatgttcaaggccatcgtcaaccggctgtga

SEQ ID NO: 2232 - DNA, 3288 bp, Unknown; identical to SEQ ID NO: 2092
  Artificiall/Consensus sequence

SEQ ID NO: 2233 - DNA, 1176 bp, Unknown; identical to SEQ ID NO: 2089
  Artificiall/Consensus sequence

SEQ ID NO: 2234 - DNA, 654 bp, Unknown
  Artificiall/Consensus sequence
atgatcacaccggaacaggtaaaaaacgaccccgcgatccgttcctatattcaaaaggcggacgcatgtttaagcgccctgggctatacggaacatagctttgcccatgtgggacgggtggcttccgaggcgaagcggatcctattggccctgggcaagggccagcggcaggcggagctggcggagatcgccgggtatctccacgacatcggcaacatcgtcaatcgggaagaacacgcccaaagcggggccattatggccttccggctgctggataagatggggatggacccggaggagagcgctgaggtgatctgcgccatcggcaaccacgacgagggcaccgcccagccggtaagcgacattgccgcggccctgatcctggcggataaaaccgatgtgcgccatacccgggtgcggaacaagcgccaggctacctttgacatccacgaccgggtcaactggtctgtccgccacagcgaattgaccctggagccggaatgccgcgccatcaccctgctgctcaccatcgataccgagatctgctcggtgatggaatacttcgagatcttcatcggccgcatggccctttgccgccgggccgcccagcggctgggcctgcgcttccacatcgtcatcaacggccaggagatc

SEQ ID NO: 2235 - DNA, 1485 bp, Unknown
  Artificiall/Consensus sequence
atggtaaggctctataccaaccggcctgggtttttcaacgacatcgccgaggagatccggctgtttttcccagatcctgaggtgctccccctggaggagaccgggcccctggctccgggggagggggaagccagcgtgatcttggaactgggggagacctggcaggcccatgccaaggccgcctacatgcaggagggcagcttgcgccaggcggaatatacttatgtccatcccccggtggcgggcaacgaactggtgcaaaagcggtatgaaaaacgctgcgtgaagatcgccatgttccgggcgctgtgcaggctctttccggaagccaaactgccctggggctccctgacgggcatccggcccacccggctgcttcgggaactggtggagggggagggccccgaggaagccaagcggatcatgcaggaggaattcgatgtatccctggacaagctgcggctgtgcgcggagatcaacgccgcccaggccccggtgctgcgggagcagacgcccagggatctggacgtatacatcggcatccccttttgcgccacccggtgcctttattgctcctttctgagccaggtccggggccccaaaaccgatatggcggcctatttgaccgccttgcagacggatatccgcatgggggccgccttgatgcgggaggcaggctataccctgcgggctatgtatgtgggcgggggtacccctaccgtattgacccgggacgagctggcccaggtgctggaatgcgccctagacgcctatggcggctacggcagggagctgacggtggaggcgggaaggccggataccatcacccgggaaaagttgaccctgatgcgggatctgggcgtgggtcggatctccatcaatccccaaaccatgaacgagaaaaccctcgtccgcattggacgccagcacaccccggcggatatccgggcctgttatgccatggctcgggaaatcggatttgctagcatcaatatggacctgatcgccggtctgcccggggagggcgttgcggatatggcccgcaccctggaggagatccaacgcatggccccggaaaacctgacggtgcacaccttggccatcaagcgttcctccggcttgaaagcccatttggcggaataccccctgccagctcctcagacggtggagcagatggtgggcatgggccgtttgacggctgcccggatgggcctgatcccctactatatgtatcggcaaaagtatatgcggggaaatttggaaaacgtgggctatgccaagcccggggccatttgcctatacaatgtggatatgatggaggagaccacctccattctggcccacggggccggggccatgagcaagcgcatctttggcggggagcgccgggtggaacggatccccaatcccaaggacatcgagacgtatatcgggaagcttcccgctgtaaaccagcaaaagcgcagcctattcggcctggaatag

SEQ ID NO: 2236 - DNA, 828 bp, Unknown
  Artificiall/Consensus sequence
atgaagcggacggtcttcgcctatccctatatcgtctggatgctgattttcatcctggcccccatgctgctgatcatctggtacgctttttccaaggacggcagctttaccctggccaaccttaccacggccctgaaggaccccatctacatgcaggtgctgctgcgctccgtatggatcgccttcaaggccacggtgatctgcctgctgctgggctaccccatcgcctggttcctctccaccatgcgcaaaagcaccgcggccatcctgtacatcctgttcatcgtgcccatgtggatgaacttcctcctgcgcacctacgcttggcaggccatcctggacagcgccggtatcctcaacgtgatcctggaattcttcggcctgcccccccagcacctgctgtatacggaaggggccattatgctgggcacggtatataacttcctgccctttatgatcctgcccatctattccgtgctggtaaagctggataaatccctggtggaggccgcctatgacctgggcgccaacggggtcaccacctttttcaaggtgatcttgccccagtccgtccccggcatcatcagcggcatcaccatggtgttcatccccgccatcaccgcctttgccatctcccggctcctgggcggcagcaagttcatgctctacggcgatttgatcgaaaaccagttcatcaccctgggccgggacgcttggcctgtgggcagcgccctgagctttatcctgctggtgctggtgctcatctccatggccatcatgcgccgggctgagcgggaggccggcgaggaagggggtatgctctggtga

SEQ ID NO: 2237 - DNA, 618 bp, Unknown
  Artificiall/Consensus sequence
atgtggggtcttttgcataaggatctgaaaaccatcagcctccagggccgggtgctggccatcatggtggtgttttacctggcctttttcctcctctccgaagcggaggacgcccttatttcggtggtcaccttctctaccgtcctaatggggatcttgtttcccatcaccgcgttgagttatgatgaaaaggccaagtgggagcattacgcccttaccatgcccatctcccggaatatgctggtgtggagcaaatacctgctggtgctgctgtttctgctggccggcgaattgctgctcctgctggtcagcctcttccagccggaaatcggcccggccctactggtgctggtgccggggatcgtcctgttcctaaacagcatcctcctgcccgtggcctttaagctgggggtggagaaaagccgctatatcaccgtggcgatcatgctgctgcccacattggtgctgttgctgatggaaaagctgggcgtccagccgccccaattgtccgcccgcctattggccctgctgcccctgctgttgctggccttttcggtgctgctgttttacctgagcgggctgctttcctgccgcctttaccggggccgggaattctga

SEQ ID NO: 2238 - DNA, 1650 bp, Unknown
  Artificiall/Consensus sequence
atggaagaacggttgaccccaaagaattttattgaggaatttatccagcaggatatccaggaaaaggggctttcccatatccagacccggttcccgccggagcccaatgggtatttgcatattggccatgcgaaagcgctgttcatcgatttttccatggcggaaaagtttggcggcagctgcaatttacgctttgacgacaccaaccccaccaaagaggatgaggaatttgtggacgccatccaggaggatatccggtggatgggcttccattgggaccatgtatttttcggttccgactattttgatacctgctatgaattggcggtcaagctgatcaaaaagggcgtagcctatgtctgcgacctgagcaaggacgaaatgcgggaataccggggcaccctaacggagcccgggcgaaatagcccttggcgggaccggagcgtggaggaaaatctggacctgttcgagcggatgaaaaacggggaattccccgatggcagccggaccctgcgggccaagatcgatatggcttcccccaatatgaatatgcgggacccggccatgtaccggatcatccacatgcgccaccatcacacgggggataaatggtgtatctatcccatgtacgattttgcccatcccatccaggacgccatcgaaggggtgacccattccctctgctccctggaatatgaggatcaccggcccttatatgactgggtggtggagcaatgcgaatttgaacacaagccccgtcagatcgagtttgcccggttgaacctgaccaataccatgatgagcaagcggtatctaaggcgcttggtggaggaagggcatgtgaccggttgggacgatccccgtatgcccaccctgtgcggtctgcggcgccggggctatacggcggaatccattcgggatttcctgacccgggtgggggtcgccaaggcggacagcgtggtggagaccgccatgctggagcactgcgtccgggaggatctgaacgcccatgcccatcggatgatcgcggtattggaccccatccggctggtggtggaaaactggcccgagggcaaaaccgaggcggtggccatggaaaacctgcccagcgaccctgccgccggcagccgtaccctcacctttagccgggagctgtacatccagcgggaggatttcagctatgacccgcctaagaagtatttccggctcaagcccgatggggaggtgcggctcaagggcgcctatatcgtcaagtgcacccgctatgagaccgacgaagccgggaatgtgaccaccgtgtactgcacctacgacccggaaagccacagcggcgagggccaacgcaaggtaaagggcaccctccattggctgtccaaggaggacgccgtgcccgccgaattccggctttatgaggatctgctcctgcccgagaccccggaaaacgcccagctggattttacccagcggctgaacccggattccatggtgaaaaagcagggctttgtggagcctgccctggctgcttgcgcccctggctgccggtatcaatttatgcgggtggggtatttctgttccgacctggaccatacccctgcagcccccgtattcaaccggatcgtagggctaaaggatagctttaagatgaattga

SEQ ID NO: 2239 - DNA, 1068 bp, Unknown
  Artificiall/Consensus sequence
atgcggcatatttcatcatcattggcggggaggaagaacatatccatggttgcctcaggcaaaaacgagatcatcaccatccgggggctgaataagaccttcggatcgggggacacggcggtcaccgccctttccggcatcgacctgacgatttacgagggggagatcttcggcatcatcggcctgtccggggcggggaaaagcaccctggtacggtgcatgaactacctggaaaagcccacggacggcagcgtggtcatcgcaggccaggccctggaaaagctccaacccggggaattgctcacagcccggcggaacatgggcatgatcttccagcaattcaacctgctcatgcagaaaaacgccatccaaaacatctgcttccccctggagatcgccggggtgcccaaggcccaggcggtaaagcgggccagggagctattggaggtggtggagctgcaggataaggaaaaggcctatccagcccagctttccggcggccagaagcagcgggtggccattgcccgggccctggcggccaaccccaaggtgctgctgtgcgacgaggccaccagcgccctggaccctaccaccacccgttccatcctggacctgctcaaggagatcaaccagaaattcggcatcaccatcgtggtgatcacccatgagatgagcgtcatcgaggagatctgcgaccgggtggccatcatcgacaacagccgcatcgcggagatcggcagcgtggaggatatttttatgcggcccaagacggagatcgcccggcgcttgctctacgccagcggccgcctgggggaggagatgatgagcgaacgctgcctgcggatcatctttgacggcaccaagacctccagcccggtgatcggcaacatggtgctggagtgcggcgcgcctgtgaacatcctctttgcagataccaagaccattgagggaaagatggtgggctataccctggtgcagctgccggataatgaaggcgtggtggccaagatgaagaaatacctggatatgcaccaggtgcattatttggaggaggcatatcatgtttaa

SEQ ID NO: 2240 - DNA, 1317 bp, Unknown
  Artificiall/Consensus sequence
atgggcagctacatcccctccaccaaggcccagcagcaggaaatgctatcccagcttgggctacaggatttcaaggggctgtatcaggacgtacccgccagcatgtatctggagcaggggctcaatatccctgccggcatgagcgagctggaggtgcgccgggcggtctccgccatggcaggggaaaaccgggtgttttccaccgtgctgcggggcgccggcgcctacgaccattatatccccagcatcgtcaagtacatccccgccaaggaggaattcctcaccgcctataccccttaccaggcggaaatgagccaggggatcttgcaatccatctttgaataccagaccatgatctgcgagctgaccggcatggacgtgtccaacgcctcggtatacgacggggccacggcagccgccgaggcggcggccatgtgccgggaccggaagcgcaccgtgacgctggtgtccgccgcagcccatccggataccatcaacaccatccgtacctattgctacggggcggggtgtgagatgcggctggtccccctgcgggagggcaagaccgacctggcagccctcaaggacatgctggcagccgatgtggccagcttctatgtgcagcaacccaacttctacggcctcttcgaggacgcccaggccctgggccaggcggtgcacgaggccggggccatgtatgtgatgggctgcaaccccatcgccctggccatcaccaagaccccggcggcttgcggggcggacgtggccgtgggggaaggccagcctttgggcatgcccctttcctacggcggcccctatttagggtatatggccaccaccaaaaagcacatgcgtaaactccccggccgcatcgtgggggagacggtggacaaccggggggagcgggccttcgtattgaccctccaggcccgggaacagcacatccgccgggaaaaggccagcagcaacatctgctccaaccaggccctgtgtgccctgactgccggggcgtatatggccgccatgggccccgagggcatggcggaggccgcccggcagagcatggccaaggcccattatctggcggcagccctgtgccagatcccaggggtatccctgcggtatccgggcgcgttcttccatgaattcctgctggatatgccccaggcggacgccttgcttgccgccctggaggaagcggatatcctgggcggcctgccggtggacgggggcgtgctgtggtgcgccacggaaaccgtggaaaaggccaagctggatcaaaccgtggccattgcaaaggaggtgtgcgggcaatga

SEQ ID NO: 2241 - DNA, 2469 bp, Unknown
  Artificiall/Consensus sequence
atgaccaaatccctgtttgtggaccccaaggcagcgcggggcgcggcgcaacccatccggttcccggagatccctgtcaacgtatatcaaaagaccgtcaaggacgagcttggcaacttcaccacggaggactttttgcatatctatcgggatatgtgctatatccgggaatttgagaccatgctcaacctgatcaagaccaccagcgaataccagggggtctcctatacccatcccggccccgcccacctgggcatcggccaggaggcggcctatgtgggggaagcctatcacctgaccccggcggattacaccttcggctcccaccggagccacggggagatcctggccaagggcctgcgctccatccaggtgatggaggagggcgccctccaaaaggtcatggaggaattcttcgggggcaagacctacaacgtgatcaaggatgacgccaaatccatccgggagcagggcatcgacttcctgctttatggcatgatgtgcgagacctttgcccgggaaaacggcttcaataagggcctgggcggctccatgcacgccttctttacccccttgggcatctatcccaacaacgccatcgtaggcggcagcggcaccatctccgtgggcgcggccctctacaaactgtgcaacgataaggaaggcgtagtggtgtgcaacatcggcgacggttccatcgcctgcggtcccgtgtgggagggcttcatgatggctaccatggaccagatcaagtccctgtggccggagggcaagcgggccctgcccatcatcttcaacatcaacgataatttctatggcatgggcggccagacccgaggggaaaccatgggctacgacatggtggcccggatcgccgcgggcatggagcccaacgccctccatgcggagcgggtggacggctacaaccccctggccgtgatcgacgcctatgcccgcaagctccccgtggccaagacccagggcccggtgctgctggacgtggtcacctaccgggtcagcggccacagcccttcggattcctccagctaccgcaccaaggaggagatcgaagcctggcaagagcaggattccatcgtgtccttcggcaagcagctggtggaggccggggtctgcaaggaagcggacctggccgccatccgggaaaaggttgctgcagatatgctgcgcaacatgaagctggccatcgacgagaccgtgtccccccggatcgacatctttggcgcggagcagaacttcattggggacctgatgttctccaaccagaccgtccgctccatggacgaaagccggcccagcgatatgctcctgcccaaggcggaatgcccccgggtccagcagatcgccaaaaagcaccgcttctacctggacgacaacggcaagcccgtgcccaaggccagggtctatcaataccgggacgccatcgcggagcccatcatcaacaaatactatgaagaccccaccctggtctcctttggcgaggatgtgcgggattggggcggcgcctttgccgtctaccggggcatgaccgaggccatcccctattaccgcctgttcaacagccccatcgcagaggccgccatcgtaggcgcggcggtgggctatggcatgagcggcggccgggccattgcagagctgatgtactgcgacttcctgggccgggccggagacgaggtgttcaaccagctgtccaagtggcaggccatgagcgccggtatgctgaagatgcccgtggtgctccgcatgagcgtgggctccaagtacggcgcccagcatagccaggattggagcgccctgtgcgcccatatccccggccttaaggtggtattccccgccaccccctacgatgccaagggcttgatgcaagccgccctcaacggcaccgacccggtgatcttcctggagagccagcggatctacgacgtggcggagcagttccaccagggcggcgtgcccgccgaggaatatgagatccccttcggccagccggacatcaagcgccccggcagcgatgtgaccatcctgtccatcggcgccaccctgtaccgggccttaaaggctgcggacatcctccaggagaaatacggcctgcgcgccgaggtcatcgacgcccgctccatcgtgcccttcgactacaccctggtgatggagtccgtgaaaaagaccggccgcatcctcatcaccggcgacgcctgcgagcgcaacagcttcatgcgcaacctggcctccaacatcgcggagctctgcttcgacgacctggatgccccgcctgtagtggtgggcgccaaaaactggatcacccctgcccatgagctggaaaacgccttcttcccccagcccgagtggatggtggacgccattcatcagcgtatgctgcccctgcccggccacgtaagcgcccacaactggaccgagctggagcagatccgggagaacaagcggggcatctaa

SEQ ID NO: 2242 - DNA, 1365 bp, Unknown
  Artificiall/Consensus sequence
atgatatatgatctgatcgtgctgggcggcggcccggcgggctatttggcggcggagcgggccggccacggcggcatgaaggtattgtgcctggagggccgttcctttgggggcgtgtgcctgaacgagggctgcgtgcccaccaagaccctgctgtatagcgccaagctctacgacggtgtgaagcatggggagaaatacggggtcaccgccagcggccttgccatcgaccatagcaaggtggtccagcgcaaggacaaggtggtgcgcaccctggtggccggggtccaggcggccctgaaggccaaccatgtggagacgaagcgggcctttggcaagatcgccggccgtaccccggagggctacgccgtggaggcggcgggggaaacctatgtgggcaagcggctgctcatcgccaccggctccaacccggcggtcccccccatccccggcctgaaagaagggctggagcggggctttgtgatgaccaaccgggagatcctggatttccaggaagcccccggccgcctggcggtgatcggcgggggggtcatcggcctggaaatggcggcctacttcaactccatcggcacagaggtgaccatcatcgaaatgctggaccacatcgccggggaaaacgacaaggatctggtggccctgctgcaaaagcactatgagaaaaagggcattcgcttcctcctctccgccaaggtcaccaaggtggaagggggcgccgtccactatgaaaaggacggccaggcccaggcggtggaagcggataaggtgctcctgtccatcggccggcgggccaataccgccaacatcggcctggagaccatcggggtgctcaccgagcggggggccatcgtcaccgatcgccatatgcgcaccaaccagccggaggtgtatgccgccggggatgtgaacggccgctccatgctggcccataccgcctaccgggaagccgaggtggcggtgaacaacatgctgggcaagcgggacgtaatgcgctacaacgccatccccggggtgctgtataccaacccggagctggccgccgtgggggagacggagtacaccgccaagcaaaagggcttggacgtgcaggtggtgaagctgcccctccagtattccggccggtatgtggcggaaaacgaaggcggcaacggcatcttcaagctggtggtggaccaaaagcagcgcaccgtgctgggggcccaggccctttgcaactatgccagcgaattcatcgtggcggtgggcgccttcatcgagctggggcttaccctggaggagatcaaagaggtggtattcccccatcccacggtttgcgagatcatccgggaggccgttttccaggcctaa

SEQ ID NO: 2243 - DNA, 561 bp, Unknown
  Artificiall/Consensus sequence
atgtcccgcaaccggtacacggtagctcgaaaatccatatggtatgtgctgcgcaccatgctggccatcgtggccgtggtggtcattgccctatatgcgtttatcggggccatgcatgtgagcaatatttatatcctggtcagcgagggaatggagctgcgcgcatcctgcatcctcaagggcggttccatcaacgagctgacggaatattttaccgaggatttcatcgcctcggattccgccttatacgatgggaagtatgcggattataccattaccaatttcatttataagcaagatcccaccgggttatttgtgctgccctgggatgtgaccgcctccatggaggtgacggagagcatgttgtccctatccggcacccccaatgaaaacgccgccagcagtaccattcccccttggacgccgacccggtatagcgtaaagctccggcagatcgacggccggtggtatatttgcgacctggtggtgttggaggaaaatccccagcaggaagccaaccccaccccagatatgtctctgctcccctcccctaccccatga

SEQ ID NO: 2244 - DNA, 2058 bp, Unknown
  Artificiall/Consensus sequence
atgaagcaagcgtatcagccactgtttaccccctggaagatcggcaaggtggagatcaaaaaccgcattgtcatgtgttccatggggggcacctccatcttcggctggatggagcccaaccattttgaccgggaggcggccaacttcctattggagcgggccaagaacaacgtggggcttttgctccccggcatcgcccccatccgggaccccatgggcggccgctggctctatcagaacccggccaagttcaaggccctcaaagcctttatggaggaatttcataagactggggccaagctgttcatccagctgaccgccggcttcggccgggccatggcggtgaacgacatcatggtaaagatggccaaaaacaaggcgctggggttcctgggcaagcccatcttcgatatggacttcatcctggcttccgcctccgccacccccaaccgctgggcggacggggtatattcccggccctttaccgtggcggagatccagcagatcgtcgaagcctttgccaaaaccgccaagctgtgccaggaggccggggtggacggcattgaggtccacgcggtgcatgaaggctataccctggaccaattcgccctcaaatacaccaaccagcgcaccgaccaatacggcggctccctggagaaccgctaccggtttgccgccgagatcgtccaggccatcaaacgggattgcgggcaggatttcccggtctccctgcgctacagcgtggtttccaagaccaagggcttccgccaaggcgccctgccccaggagaccgactatgtggaggtaggccgggatatggaggaatccaaaatcgcagccaagttcctccaagacgcgggctatgatatgctcaactgcgacaacggcacctatgacgcctggtattgggcccatcccccggcctatatgcccttaaactgcaacctggactatgtggcccagctcaagggcgtggtggacatccccctggtatgcgcgggccgcatgtgccccgaggaaggggctgcggccatccaggccggccgcatcgacgccatgggcgtggcccgccagttccttacggatcccgaatgggtcaccaagatgctggaggatcgggaggaggacatcaagccctgcatctgctgccacaatgcctgcttcaccatggcccactacgagggggtggccaacgaccaggatctgatggacgccctgcacatggcccgttgcgccctcaacccccgcaccatgcagagcaaaaagtataaactggaaaaggctgccgtccccaaaaaggtggcggtgatcggcggcggcgtgggcggtatggaatccgccctggtgctggcccagcggggccatcaggtgaccctgtatgaaaagtccggccggctggggggcgtattcgtccaggcggcagccccctcctataaggaaaaagaccgggaactgatccaatggtattgccgggagatcgataagcagcccaacatcgccgtcaagctgaacaccccggtggaaagcctggacgccctccaggcggacgcggtgatcgtggccacgggggcaacccccaaaaagccccccatccccggcctggagcacgccctggaagccacggatttcctggccggcgcgccggtgggcgaccgggtggtgatcctgggcggcggccttaccggctgcgagatcgcctacgagctgctgcttcagggcaagcatcccaccattgtggagatgaaaaacgacctgatcgccgccaagggcgtttgcctggccaacagttcctacctaagggaggccctggccctataccaggcccccgtccacctgaacaccaccatccaggagatccggccggagggcgtcaccgccagggaccaaaccggcaaaaccttcgagatcccctgcgacagcgtgatcgtctccgtgggctatgaccccaagccccgcttccccgcctcccgcaaagtgcatctggtaggggacgccaagtccgtgggcaacctgcgcacggtgatctggcgggcctgggacgtgtgcatgaagatctga

SEQ ID NO: 2245 - DNA, 1731 bp, Unknown
  Artificiall/Consensus sequence
atgtattccttggtgctcaaaaacgccaccgtgatcgatggcacagggaagcccgcctaccaggcggatctggggatcgctggggacaagatcgccgccatcggggagatccagcaggcggaaaacgccgtggacgtgtccggcatggtggtgaccccggggttcatcgacccccattcccacgcggattgttccattttcctatatccggattgcgagagttatgtccgccagggcatcaccacctttgtgggcggccagtgcggggattccaatgcgcccatccgccgctattggatgcgcaaatattgggaatacgatatgtgggacgccatcgacccctacatctatggccagacccccatccagcctgtggaaaaggccattgccggcattgaaaaaaaggcgggcattcggatcgactggcggtcctttggggaatatctggaccgggtggaacgccagggcatgggctgcaacatgatcaccctgctgggccatagccaggtgcgggcggacgtgatgggcctggatcaacgcagggcccccaccccccgggagatggacgagatgaaggcctgtgtagacgaggccatggcctgcggagcctggggcctttccacgggccgggattatccccccagcgcctacgcggacccggcggagatcattgagctgatgcgccacgccggccgccaggggggcatgtatttcacccactggaagcgcacgggcgtgcgggtaggcaccccggaaaagcccaacaagctggcaggcatcgtagaagccctggagatcggcatggcggccgaggtcaagacccaggtctcccatatctccaccggctttgatatctatccccccaacgaggatatggaccgatacgccgccaaggtgacgttggatatcttcgacgggtatctgcaaaagggcgcccaggctgcctttgacgtgatccccggccgcagcggcggcattgccatgatccccttcctggcctccaagctcatgccttgggtgcgccaggcaggttccctcagcggctttatccgcaacctgggggcccgggatttccgtaccgagctcatcgaaaagctggaagggggcgcctggtacgccctcaaccccaaggtgaacccctgttgggacgaggccatttccatcggccccagccagaaccccaaatacgccggcaagaccctccgggaaatcggccggctgctggggacgtcctccatggaggccgtcatggccctgctgctggaggagccccgcattcccatcgaggaaaacaaaaaatccgacggggagatccggggtctcctggcccatcccaagggttccccctgcacggatacctatgcctttgatttggaaggcacctatggccgggatatggagctgcccgagctgctgccccatccccatacctattgcgccttccccaaatacatcctccaattccccgcccctaccctggaggagaccatccgcaagatgaccggcgccgtggcccagttcctggagatccccggccggggcgagatccaggtgggcaatttcgccgacctggtggtattggatctgaagcgcctcaagaccaacgaaaattatgtggagccccgggtctatcccgaaggcatccccatggtggtggtcaacggggtggtggaagtggatcaacagggctttaccggacggcgtgccggccggattttacgccatcaataa

SEQ ID NO: 2246 - DNA, 1968 bp, Unknown
  Artificiall/Consensus sequence
atggagatggagctgcggtatttgcagctattgagccgggaattccccacggtgcagagcgtatgcgcggagatcatgaacctgaacgccattttgcagctgcccaaggggacggaacatttcatgagcgacatccatggggagcacgaagcctttttacacattttgaacaacgggtccggggccatctgcgagaagatcgacgagctgtttgaaagctccatcaccacggaagcccggcgggagttggcggttttgatctattatccccaggaagcgctgcaaatgatcaaaaagcaagatcgggacatggcggattggtaccgggtgattttcaaccggctgatccagatgacccggtacaccacctccaaatattcccgttccaaggtgcgcaaagccatgccgccggattttgcctacatcatggaggagatgatcaacacccggggcatcaataaggaagcctattacgataacattctgcgcacggcggtggaactgggctgcgcggataccctgatcgagcagctatgcaccctgatcaagcggatgtgtgtggacgccctgcacatcgtgggagatattttcgaccggggcccccacgcggacgtgatcctggaccggctgatggagcatcatagcgtggatctgcagtggggcaaccacgacgtattatggatgggcgcggcggcggggaatccggcttgcgtggccacggcggtgaagaactgcgtccaatacgacaatctggatatgctggaggattcctacggcatcaacctgctgcccctggcggtattctccaccgaacaatatgacgatgcggaggtattccatccccgcaagctgccggagcagaccttccggccccgggatttgaccctatattcccggatgcacaaggccatcagcgtcatccagttcaagctggaaagccagctggtgcgccgccggccggaatacaatatggcggaccgggatatgatgggccgggtggattgggagacccataccatcgagatcaacggaacggcccatcccctgcgggatacggccttccccaccgtggaccccaaggaccctgccgccttgacccccgaggagcacgccctgatggaacagctgatcgccagcttccgccagagcgaacggctccaggcccatgtccggtttttgtacagcgccggctccctctaccgccggcataacggcaacctgttgttccacggctgcgtgccctgcacggaagacggggaattccaaaccttctccttctacggccataccctcaagggccgggcgttcctggactttgccgatcagctggcccgccaaggctacttttccaccgacgaggaggagcggagccggggcagcgatttcctctggttcctgtggtgcggccgcaattcccccatctttggccgggatcatatcgccaccttcgaacgggcactgatcgaggacaaggatacctggaaagagccgaaaaacccctattaccgcttcaatgacgatgaagccttctgccgggccctgctggatgccttcgatctgcacaagccttggagccgggtcatcaacggccatatgcccgtgcgggtcaaggagggggaggacccccgcaaggccggcggccggctggtggtcatcgacggcgggttctgccgggcttatcagaagcagaccggcatcgcaggttataccatgttcttcagctcccacggtatgcgtatcgcctcccatgagcccttcgccggcaaggaggacgccatacgccggggcacggatatcacttcccattcctttatcgtggaaaatctgccccaacgcctgctggtgggggatacggataccggcgaccagatccgtacccgcatcgatgaattgcagcagctcctgcgggcctatcgcagcggccgcatcaaaaccaataccgcccccgccccccgcagacggaaataa

SEQ ID NO: 2247 - DNA, 771 bp, Unknown
  Artificiall/Consensus sequence
atgggggaaaaagccggggcaacgggcttgcgccgccccggcgcaggaaaaggaggacgtatgctaaaatataagcgggtatccctcaagctctccggggaagccatgggcggccacggggagacggtggattttgaaaaggtggaggccgttgcccggcagatccagagcctacaggccctgggggtgcaggtgggggtcaccctggggggcggcaacatctggcggggccgctccagcggggagatggaccggaaccgggcggaccagatgggcatgctggccacggtgatcaactccctggccctgcaggattgcctggccaggctgggggtgccggtgcgggtgatgagctcggtggacatgccccgggtggcagacgggtacagctcccggggggcccaggcggctttggaggccggggaagtggtgatctttgccgggggcagcgggctgcccttcttctccacggacaccgccgcagccctaaaggcggcggaaatgggggcggacgtgatgctgctggccaagaacgtggacgcggtatatagcgcggaccccaagaaagaccccaacgccaagcggtatacccatctttcctacgaccaggtgatccaggcggatttgaaagccacggacctgaccgccatcaccctgtgcaaagagcaaaacatccccattttggtattcgccatggcccaggaggagaacatccgcaaggcggtctgtggggagccggtaggcaccctgatcgacgggacggaagcataa

SEQ ID NO: 2248 - DNA, 1326 bp, Unknown
  Artificiall/Consensus sequence
atgggggacaccatgcaatattcagcaaaagagatctggacaatggctttaagcagcctacgtaccgagatgacgcccaccagctacaatacctggatcttaaccatcgacccggtatgttggcaaggggatactttggttttgcaggcacaaaacgacgcggcccgcaacaccctgcggaacctgtacgcggtcaccatcgagaagatcctcaccgagatcaacgaggggtatcctgtcaataccctttttatcctgcgcaacgagcgggagcaatacgaaaagctggcggacaacggcccggaaatgatgatgaaccctcgctataccttcgataatttcgtcatcggctcttccaacaatttcgcctatgccgcggcccgggccgtggcggacagcccctcccgggcctacaaccccctattcatgtacgggggcgtgggcctgggcaaaacccatttgatgcacgccatcggcaaccagatcaaggaaaccttcccctcctttaagatcgtctacgtgaccagcgagacctttacctatgagctgatccagtctatccaggagaacaccaacgcccagttccgcaacaaataccggaacgtggacgtgttgatggtggacgatatccagttcatctccggcaaggtatccacccaggaggaatttttcaataccttcaacgccctgcaaaccagcggcaagcagatcgtcatcagctcggataagccacccatggaaatgcttaccctggaggagcggctgcgttcccggtttgaggggggcctgatcacggacatccagcccccggacctggagacccgcatcgccatcctgcggaaaaaggccaccctggaaaagatcgatatcgacgaggacgtcctggcctttatcgcggaaaaggtgaacagcaacatccggcagctggaaggggccctgacccgggtgatcgcctattccaagctgacccgcaaggacgtggacatcctgctggcggataccgccctcaaggacatcgtgcgggggtttgaagcccccaaggtatccatccagctgatccagcaaatcgtggcggattattacgacatcgacgtggaaggcctcctatcccagcggcgcacggcggatatcacctatccccggcagatcgccatgttcctgtgccgggaaatgaccggggattccctaaagaccatcggcaagcatttcggcggccgggactattccaccgtgatcagcgcctacaacaagatcatggccgacctgaaaaaagacccggaattgggccttaccctggacgatctgcgcaagcgcatcaaaaaatga

SEQ ID NO: 2249 - DNA, 1029 bp, Unknown
  Artificiall/Consensus sequence
atgttagaccagctttgcggacatgccctcaagcccatggatcatcaaatcatcaccgttccggtcaccaaggacctgggggtggatgtgaacatgaccgcccatgtgctcaccggccgggaacccggccctaccctgttgatcacctccatgctccacggggaggaatggttttccgtgctgatcatccgggccctgtttaaggccctggaccttggcaagctcaaggggaccattatcgccatcccggtggccaacgagtccgccttcaataccaacacccggtgcgtcatggataattccgacgagccggacgccaaccgttcctttgacggccggtacaactgccttaccaacctgatctgccgctgcgtggaggaaaacttcctctccaaggcggattacctgatcgactaccatgtggggacctggggcaaccggatggcggacatcggttatggctcggattacccggacgcggagctggtgcggatcagccggggcatggccaaggcctattgcttcccggtgctccacgccatgcggctcaaccagggcacccacagcgcccgcaacgccatgggctgcgccgggctgaaatacggggtgccggccatcgtgccggagatcggcggcctgggctttggccaggcccaagaggacgcctggatccaggataatatccggggcctgttgggcaacctcagcttcctgggtatgctggaaggggagatcccctactgcgaacaatacctggaggtgggggaatatttccgtgtatccccgaaaaacggcggctacgtggagctggctctccccagcgccggcgccctgaccccggtgaagcgggatcagctgctggcccgggtcatcgaccccaagaccttcgaggtgctggaggagctgcgcagcccctgcgacgggatgatcttctacggctgccgcaactacatggtgcggcccggcggctgggtgttcggcgtagccaatatggaacacaattgcagcaaatgggtgggtgctgattga

SEQ ID NO: 2250 - DNA, 1173 bp, Unknown
  Artificiall/Consensus sequence
atgagagattccctgttgagcctgttcccggcggccgaatacgaggcgaggctggccaaaattgtggagcagatgcagaagaacggcgtaggcgccctgatcctcaccagcgatgagaacacctactacttctccggcttccgcagcatcgtatggtgcagcaaggtttccacccccggtgtattggtgatcaccgacgacggcagcaccgccatcgccaccaccaagggtggcgcggagaccgtacgggtcacctccagcgtggaggatatccgccgctttggcaccgctgagtaccccacctacgcccaggccatcgtatccctgctggcggaaaagggcaagctgaacggccgggtgggtatggaattcggcaccggacataagatccatctcaactatgacatgacccagcagctcttcgccgcccttaaggacgccacgttggtagatgcggcggatatgctctgggctgtgcgttccatcaaatcccccctggagatccaggccatccgcaaggcctgcgacatcaactgcaagggcatcgagcggggctttgaccggctccgggccggctacaccgagctggagctcaactccatgatcatggaggaatactaccgcctgggtgcggaatcctccctgaccctgggcatccgggctggcgcggaacgctattcccagggcaattgccccccctcccggcggcccatccagcccggggagatcatcctggtggacggcggccccagctatgacggctatgtgtccgatatcatccgggaagcggtcatcggcaagcccaccgactaccagcaggagatgttcgacgtggcccgggaagcctgctaccggggcatcgacgccatgaagcccggcacgcccatcgaccaggtggtgaaggtggtggacgactttatggacaacagcaagttcgccgagatcaacgtatacaagcactggtgcggccacagcatcggcgtgggcgttcacgaataccccatgctggattccgatacccacatcctgcttaagccgggtatggtgttctccatcgaaccctacatcttccaggataacgtgggcagcctgggcatcgaggagaacgtcctcatcaccgagaccggcgctgagatcctcaccccctcggatagccatctgcgtaggctgtaa

SEQ ID NO: 2251 - DNA, 669 bp, Unknown
  Artificiall/Consensus sequence
atggaaccatttaaaattttagagatcaagcaaagcgtgttcgcggataacgaccgccaggcagacgccctccggcaggagctgaagcagcggggcatctttttgctgaacctgatgtcctcccccggcgccggcaaaaccaccaccctggtgcagaccatccgggccttgcagggaatcttccccatggccgttatggaagcggacatcgattccgatgtggacgcccaaaccatcgccgccaccggcgtgcaggccattcagctccatacggggggcatgtgccacctggacgcggatatgacccgccagggcctccagggcctggaaggggtggagggcgccctggtgatcttggaaaacgtgggcaacctggtttgcccggcggagttcgacaccggggccgtgaaaaacgccatgatcctttccgtgcccgagggggacgataagcccctgaaataccccctgatgttttccatctgcgacgtggtgctcatcaataaaaccgacgtgctgccctatttcgatttcgatttggaggcctgccggcaacgcatcctgcgccgcaaccccaatgcgaaggtcatccccatctgcgccaagaccggccaggggatggagccctggttccagtggctccaagaacaagtgaacgattggcggggatag

SEQ ID NO: 2252 - DNA, 2415 bp, Unknown
  Artificiall/Consensus sequence
atggctaagaaaagcgagccccagcttcccctgggggaaaccatcatcgagaagagcatggacacggtgatgcacgaatccatgctgccctatgcggaatacgtgatcctggagcgggccttgccccgggtggaggatgggctcaagccggtgcagcggcggattttgtataccatgctggagctgggcaccaccccggataagccccaccggaaaagcgcccgcatcgtgggggattgcctgggcaaataccatccccacggggacacctcggtatatgacgccatggtgcgcatggcccagccctttaacatgcagatgcccctggtggacggccacggcaactttggcagcgtggatggggacagcgcggcggccatgcggtatacggaagcccgcatggcgcccatcgccctggagatgctgcgggatttggacaaggacacggtgccctttgccctgaactttgacgataccctcaaggagccggagctgttgcccggccggttccccaatctgctggtaaacggggccagcggcatcgccgtgggcctggccaccaacatccccccccataacctgagggaagccatcgacgcggtgctgctgcaaatggagcagccggaggtttccctggacgccctgatgcaggtgatgccctgtccggatttccccaccggcgggtatcttctcgatagcccggagatccgtgccgcctatgagaccggccggggcaagctgaccatgcgggccaaggtgcatatggaggagggccgtgcgggccgcaagctcatcgtggtgaccgagtttccctatcaggtaaacaaggcccgggccctggaggacatcctcaaggtaagccaggagaagaaaaccctgtttgccggcatcgcggatatccgggatgaatccgaccgttcgggcacccgggcggtgatcgaggtcaagaaggacgcggacgcggataagatcctggcgtatctatataaatatagcgatctgcaaaccaccttcggggtgaacatggtggccattgccgggggcaagcccctgcagatgggcctcaaggagatcatcgcccattatatccgccaccaggaggaagtggtcagtcgcaggacccgcttcgacctggaagcagcccagcggcgggagcatattttggaagggctcatggtggccatcgccaacatcgatgcggtgatcgccctgatccgggcctccaagaccccaaaggcggcccgggacgggctgatggagcgcttcggcctcacggagctccaggcccaggccatcttggacttacggctgcaacggctcaccaatctggagctactggccatcgaaaaggaatataagcaggtcaaagccctcatcaaagagctgaccgccattttggaatccccgaaaaagcttcggggggtgatcaaaaaggagctggaggagatccgggacgcctatggggttccccggcgcacccagctgatgcaggaggatgcgggcgcagtcctgcccgaggaggaggctcacgtcagcgaggaggctctggtggtgctgctgcctggggcgcgggttcggcgcatgccgcccaaggcgtataacccggaacaaggcgccggggaaaatcccttggcgctgatccagacggccaccgatcggcggctaaggttctttacaaacctgggcgcctgttgcttcctgccggtggaggagatcccggagacccggctcaatgggaagcctgccaatttaaacgcccttatcgcctttgaaaaggacgaacaggtggtggcttgtctggaggagggagaatgcgagggccagctgtatttctacaccgcccagggcaatgtaaaatgcacccagggcagcgagtacaatgcccgcacccgccgggtggcggccatctccctcaaggagggggacaggctgctgggggtggagcccgcccgggaggacagcatcctgctgatcaccagccagggcatgagcatccgctttgcccgggacaccgtcccggagatggggcgggtagccgccggggtaaagggcatccggctggaagcgggagaccaggtggtctttgcccagcaggtgggcgaggacggcgaggtgctcaccatttccgaccggggctacgccaagcgcagcttcgtgttcgaccatgagctgcagggccgcaacggaaaggggctcaaagcctttgactttaagaaaaacggttccaacggcacggccattgctgcggcgctgtatgtacgagagccgtataactttaccgtggagcagaagcatggggctgtgaccctttgcaatacggaggaagtgcgcatcgataaccgggccggcagaggggatctattggtgatggccctgctggacgatgtggtgatcggcgcccgtaggcagcgataa

SEQ ID NO: 2253 - DNA, 726 bp, Unknown
  Artificiall/Consensus sequence
atgaagcagctgttggaagccggcgttcacttcggccaccagacccgccgttggaaccccaagatgaaggagtatatcttcaccgagcggaacagcatctacatcatcgacctgcaaaagaccgtcaaaaaagtagaccaggcttatgatttcatccgcagcgtggcggaagccggcgaagcggtgctgtttgtgggcaccaagaagcaggcccaggaaagcatcgagcaggaggccaagcgctgcggcatgttctttgtgaaccagcggtggctgggcggtatgctcaccaacttcaagaccatccagacccggatcgcccgcctgcgcaagatcgataagatggagcaggatggggatttcgccctgctgcccaagaaggaagtcatcaagctcatggccgagcgggataagctggaaaagaacctttccggcatcaaggaaatgaagcggctgcccggcgccatgttcgtggtagacccccgcaaggagaacatcgccgtgcaggaagcccatgccctgggcattccggtggtggccatcgtggatactaactgcgaccccgacgaggtggattatcccatccccggcaacgacgacgccatccgcgccgtcaagctgatcgcctccaagatggcggacgccgtgctggaaggccggcagggcgagcagatggaagacgtggccgaggaggccccggaagccaaggacggcgacgatttttaa

SEQ ID NO: 2254 - DNA, 1188 bp, Unknown; identical to SEQ ID NO: 2113
  Artificiall/Consensus sequence

SEQ ID NO: 2255 - DNA, 3744 bp, Unknown
  Artificiall/Consensus sequence
atggtgcatgaggtgcagatgggcaaaaagacgcgtatgagcttttcccggatcaacgaagtcctcgacatgccggacctgatcgaagtacagaaaaattcctaccggcgttttgtggaggaggatcttaaggaggtgctcgccgacgtttcgccgatcacggactattccgaaaagctcatcctcgaattcgtggactataagatcgacttcgagcatcccaaataccctgtggaagagtgcaaggaacgggatgtaaactattccgcgccactgcgagtcaccgtgcgccttataaataaagaaacgggagaggtgaaggagcagccggtattcatgggggacttccccctgatgaccgagcaaggtaccttcatcatcaacggtgcggagcgggtcattgtcagccagctggtccgttcccccggcgtatatttttccgaggccatcgacaaggtgggcaagcacctgttttccgcccaggtcattcccaaccggggcgcctggctggaatatgaaaccgactccaacgagatcctgtacgtgaagatcgaccggcagcgcaaggtgttcatcacggcgcttttgcgcgccttgggctatggcaccaacgcggaaatcgtggatcttttgggggaggaagatcggctgctgaccactttggaaaaggataccacccacagcgtggaggacggcctgatcgagatctataagcggcagcggcccggcgagcctcccaccgaggagagcgcccggaacctgctcaacgccctctttttcgataagcggtacgacctggcccgggtcggccggtataagttcaacaaaaagctgtccctggcggcccggatcagcgggttcattgccgccgaggacgtgatcgaccccgccaccggcgaggtgcttctgagcgccggcagccacatcagccgggaacaggcccgcctggtggaaaacgcgggggtacacgcggtctatttgcagatcgaggataagaagatcaaggtgctggggaaccgttttgtggacgccagcggctatctgtcctttgatccggaggaagcggggctgaatgaaaaggtctatcatcccgccctggtggccctgctggaagagggcaaggatctggatgaggccgggctcaaggccctgctgcgcagccatgtccacgacctgatcccccggcatatcgtgccggatgacatcatcgcctccatcagctacctgatcggcatgaattacggcatcggccgcaccgacgatatcgaccacctgggcaaccgccggatccgcagcgtaggcgagctgctgcaaaaccagatccgggtgggtatgacccgcctggagcgtgtggtgcgggagcggatgagcctgcaggatatggaaacggccatgccctccagcctgatcaacatccggccggttaccgccgccatcaaggagttcttcggctcctcccagctttcccagttcatggaccagaccaaccccctggcggagctgacccacaagcgccggctgtccgccctgggccccggcggcctgaaccgggagcgggctaccttcgatgtgcgggacgtgcacttttcccactatggccgtatgtgccccatcgagacccctgaaggccccaacatcggcctgatcaactccctgtccacctatgcccgcatcaataaatacgggtttatcgaggccccctaccggaaggtggacgcggccaataagaacatcctgggggagatcgtatacctgaccgccgacgaggaggacgacttcatcgtggcccaggccaacgagcccaccgtggaaaaggacggcaaggtatggttcaagcgggaccgtgtggtggcccggcggctggatgagatcatcgaggtgaagtccacggaggtggactacatggacgtttcccccaagcagctggtatccgtggccacggccatgatccccttcttggaaaacgacgacgccaaccgggccctgatgggctccaacatgcagcgccaggcggtgcccctgctgatgccggaggcccccatcgtgggcacgggcatggagtataaggcggcccatgactccggcgtggtgatcctggcccgggaagccggcgtggtggcccgggtggacgcggataagatcgttatccggggggacgatgggatcaaccatacctaccggatcctcaagttcaagcgttccaaccaaggcacctgcatcaaccagcggcccatcgtatacaagggcgagcgggtggcgcccggccaggtgatcgccgacggcgccagcaccgataagggggagatcgccctgggccggaacatcctcatcgggttcatgacctgggagggctacaattacgaggacgcggtcctcatcagcgaaaagctggtgaaggaagatatttatacctccatccacatcgaggagcatgagaccgaagcccgggataccaagctgggcgaggaggagatcacccgggatatccccaacgtgggcgaggacgctttggcggacctggatgagcggggcatcatccgcatcggcgcggaggtgcgcagcggcgatatcctggtgggcaaggtgacccccaagggagagaccgagctcaccgccgaggagcggctgctccgggccatcttcggggaaaaggcccgggaggtgcgggatacctccctgcgggtgccccacggggaaggcggcgtgatcgtggacgtgaaggtattcacccgagagaacaaagacgagctgcccccgggggtcaacgagctggtgcgggtgtacatcgcccagaagcgcaagctctccgtcggggataagagggcgggccgccacggcaacaagggcgtggtatcccggatcctgccggaggaggatatgcccttcctgccggacggcacccccctgcagatcgtgctgaaccccctgggcgtgcccagccgtatgaacatcggccagatcctggagctgcatctgggcatggccgccaagaccctgggctggaacatcgccaccccggtattcgacggggccacggaggaggatatcaagtccctgctccagcaggcgggccgggattgggacggtaagaccgtcctgtacgacggccgtaccggcgagccctttgagaaccgggtatccgtgggctatatgtattacctcaagctccaccacctggtggacgataagatccacgcccgctccaccggcccctatagcctggtgacccagcagcccctggggggcaaggcccagttcggcggccagcggttcggcgaaatggaagtgtgggccttggaggcctatggcgcggccaacaccctgcaggagatcctcaccgtcaagagcgacgatgtggtgggccgcgtaaagacctacgaggccatcgtgaagggcgaaaacgtgccggagcccggcgttccggaatcctttaaggtgctcatcaaggagctccagagcctgggcttggatatcaaggtcttgtccgataccaaggaggagatcaagatcggcgagatggtggacgacgacgacggcgcgcccctggatgtgaacatcgccggcaccgaggacgatcccggcatgatgcccggcggcgcggaattcaccgaattcgacgacttcgacttcggggatgacgacgacgacctgggcgacgaggatgacgacgacgggaaggacgacctggacgcggagttcggcgcgggcttttccgtgctggacgcggaggatgagcaggtttaa

SEQ ID NO: 2256 - DNA, 1383 bp, Unknown
  Artificiall/Consensus sequence
atgcgtaaagaatatcgtaccataaaagaagtcgccggccccctgatgctggtggagcaggtggaaggcgtaaaatacgacgagctggtggagatcgaacaggccaacggcgaattgcgccggggccgggtgctggagatcaacggggataaagccctgttgcagctgttcgaaggctcccagggcctgcgtatttcggattccaaagcccggttcctgggccgctccatcgagctggcggtggcgccagatatgctgggccgggtgttcgacggcatgggccgtcccaaggacggcggccccgccctgatcccggaaaagatgctggatatgaacggcgcccccatcaacccggcggcccgggactatcccaacgagttcatccagaccggtatctccgccatcgacggcctgaataccctggtgcggggccagaagctgccggtgttctccggctccggcctgccccacgccaacctggccgcccagatcgcccggcaagcccgggtgcggggcacggatgagagctttgccgtggtgttcgccgccgtgggtatcacctttgaagaagccgacttcttcatcagcgacttccgcgccaccggcgccatcgaccggacggtgacctttatcaacctggccaacgacccggccatcgagcgtatcgccaccccccgtatggcattgaccgccgcggaatatctggcctatgacctggggatgcacgtgctggtcatcatcacggacatcaccaactacgccgaagccctccgggaggtctccgccgcccgtaaggaggtccccggccgccgcggctacccgggctacctgtacaccgaccttgccaccatgtatgagcgggccggccggatcaagggcaatgcaggttccatcaccatgatccccatcctgtccatgcctgaggacgacatcacccaccccatccccgacctgaccggttacatcaccgagggccagatcatcctctcccgggatctgcaccgccggggcattacgcctcccatcaacgtgctcccctccctgtcccgtctgaaggataagggcattggcaagggcaagacccgggaggatcacgcggataccatgaaccagctcttcgccgcctattcccgcggtaaggacgccaaggagctggcggtcatcctgggcgacgccgccctgtccgatgtggataagctctacgccaagttctccgacgcctttgaggagaaatacatctcccagggcttctataccaaccggagcatcgaggaaaccctggacctcggctgggaactgctctccatcctgcccaggagcgagctcaaacgtatcaaggacgtttatctggataaataccttcctaaaaaagaggaggcgtag

SEQ ID NO: 2257 - DNA, 1347 bp, Unknown
  Artificiall/Consensus sequence
atggatcaactggcaacgctcgtttctcaagtcagcgattttgtctggaataacctgctgctgtatattttggttctcacgggtatcatttttagtattcggctgaaattcatccaggtacgcaagtttggcgaaggcatgaggcgggtatttggcggcatcaacctatttggcaagcaggctgacaaggacggcatgagctccttccaggcgctggccacggccattgcggcccaggtaggtacgggcaacatcgccggctgcgcaaccgcgttgatttccggcggtcctggcgccattttctggatgtggctatccgcgtttttcggcatggcgacgatttacggcgaggctgtgctggcgcaaaagtttaagacccgctctgagaccggcgaggtcatcggcggccctgtctactacatccggcaggcatttaagggcggctttgggaaattcctggcaggcttcttcgcagtagccatcattttggcgctgggcctgatgggcaacatggtgcagtccaactccattggcgacgccttctacaatgcctttggcgtaaacaagcttatcgtcggcatcatcattgcggcgattgcggccttcatcttcctgggcggcatgaagcggatcgcttccgttacggagaagatggttcccatcatggcggccctgtacatcgtaggcagcctggtggtcatcatcgccaacatcaagaacatccccaacgtgttctatcagattttcgtgggcgccttcaaccccaccgcagtcctgggcggcgccgctggtatcacggtaaaggctgccatgcgctttggcgtagcccgcggcctgttctccaatgaagctggtatgggctccacgccccacgcccacgcggtggccaaggtggataagccggaggagcagggcatcgtagctatgatcggcgtgttcctggataccttcgtggtgctgaccctgaccgcgctggtgatcctttccaccaactcccttggcagcggcgcggagggcgtcgccctggcccagttggcattctccaaggtatttggcaactttggcggcgtgttcattgccatatgcctgctgttcttcgccttctccaccattattggctggtatttcttcggcgagcagaacatcaagtacctcttcggtcagaaagctgtgaagatctacgccttgttagtggtgatattcgtcatcatcggttccactttgaaggtggatctagtatggaacctgtccgacctgttcaacggcatcatggtattccccaacttgttggctttgctggccctgtccggactggtagtcgccatcagcaggggcaaggacaaataa

SEQ ID NO: 2258 - DNA, 1914 bp, Unknown
  Artificiall/Consensus sequence
atgaacattacgctaccggatggcagcatccaccaatatcaggacggcatgacggcctttgatattgccgccgacatctccccccgcctgcgcaaggccaccctggccgcggagctggacggccagcggatcgacgcttttgcccccatccatggggatcatagcctcaagctcctcaccttcgccgatgaaaacggccgctgggctttccgccataccgcttcccacatgttggcccaggcggtaaagcggctgtatcccgatgtaaaattcgccattggccccgccattgaaaacggcttctattacgacttcgataccccggaaggcttctccttctccccggaggatcttgccgccatcgaaaaggaaatggccaagatcgccgcggaaaacctgcccctgcaccggtttgagctgccccgggaagaggccatcgcctatatggaacagcgcaacgagccctataaggtggagctgatccgggatctgcccgaggacgctgtcatcagcttttacgagcagggggagtttaccgacctgtgcgccggcccccatgtggaaagcacgggcaaggtgaaaaacatcaagctcatgagcgtggccggcgcctattggcggggcagcgaaaagaacaagatgctccagcggatctacggcacggcctttgaaaaaaaggcggacctggacgaatacctgttccgcatcgaggaagccaaaaagcgggatcaccggaagctgggccgggagctggatctgttcgatatccatgacgaaggtcctgggttccccttcttctaccccaacggcatgatcctgcgcaaccagctggaagccttctggcgggagcagcaccaggctcggggctataaggagatccgtacccccatgatcctcaaccgggatctgtggattcgctccggccactgggatcactataaaaacaacatgtatttcaccaagatcgacgacatggactatgccatcaagcccatgaactgccccggctccatcctcacctataagcggaagatctattcctaccgggatctgccggaacgcctgggcgagctgggcctggtgcaccgccatgagctttccggcgccctgcacggcctgatgcgggtacgctgctttacccaggacgacgcccacatcttcatgaccccggaccagatcaaaggggagatcctgggggtcatcgataagttccagtgcttctacgacacctttggcttcaagtacaccgtggagctctccacccggcccgaggatagcatgggcagcgacgagcagtgggagcaggccaccgaagccctggaggaagccctgaaggcttgcggcctgccctatgccatcaacgagggggacggcgccttctacggccccaagatcgacttccacctggaggacgccatcggccgtacctggcagtgcggcaccatccagctggatttccagatgccggagcgcttcgatatcacctatgtgggccccgatggggaaaagcatcgccccgttatgatccataccgtggtgttcggctccatcgagcggttcatcggcatcctcaccgagcactgcgccggcgccttccccacctgggtggcccccttgcaggtgaaggtgctcaccatcaccggccgggcggatgcgcgggcccaggaggtctgcggcatcctcaagaaggccgggctgcgggcggaggcggatctgcgcaacgaaaagatcggcttcaagatccgggaagcccagatgatgcgggtgccctacatggtggtcatcggcgacaaggagatcgagcagggcgtggtggctgtccggggccgcaagaagggcgacctgggcgtcatgcccctggaggatttcatggccatgatccaggaggagatcgcctccaaggcccgggattaa

SEQ ID NO: 2259 - DNA, 1017 bp, Unknown
  Artificiall/Consensus sequence
atgattatcagcaccaaactgggaacccccaaagaagaattggaaaaactggtgggaagctttgaaggccagggcatccgggtcagcgtcatcaccggtacggactatacggtcatcggcctggtgggggataccacccgcctggatgaaaagcgcatccgggccaatccctatgtggacaacgtacagcgggtatccgaaccctataagctggccaaccgcctgttccaccacgaggattccgtcatctcggtccggggcatcccggtggggggcaaggaaaagctggcggtcatcggcggcccctgctccgtggagggcaaggagcagatcgtggaggtggccaaaagcgtcaaggccgccggcggccatatgctccggggcggcgcctacaagccccgtacctccccctacgccttccagggcctgggcaccgagggggtcttggacctggtggaagcccgcaaggtcaccggcttacccattgtcagcgaactgatgagcgaggacaagatcgacgaatttgaggaatatgtggatctggtccagatcggcgcgcggaatatgcaaaacttccagctccttaaggcggtgggcaaaatgtccaagcccatcctgcttaagcggggcctggccaataccatcgaggagtggatcatgagcgcggaatacatcatggccgccggcaaccccaacgtgatcttctgcgaacggggcatccgcacctttgaaaagtatacccgcaataccctggatctttccgtgatccccatcatcaagcgcaagagccatctgcccatcatcatcgatcccagccatgccaccggggactggcggtatgtggaaagcatgagcctggcggccatcgccgccggggcggacgggctcatcatcgaggtacacgcccaccccgaggccgcctggagcgacggggctcagagcgtgcggccggagcgtttcgcctccatcatccaaaaaggccgcaccatcgcccaggtgatcggccgggatctgtaa

SEQ ID NO: 2260 - DNA, 921 bp, Unknown
  Artificiall/Consensus sequence
atgcttaaatacacgatccgcaggcttttgcagaccattcccctgttgattgccatttccttcgccgcgttcatcatgatgcacctggtccccggcgatcccgtccgcaacatgatgggcatcgaggcctccaaggaggcggtagaggcggagcgggaacgtctaggcctaaacgatcctttgctggtgcagtatggccgcttcctgggcggcgtgctgcaaggggatcttggtacttccatcttcaccaagcaatccgtcaccgacgagattcttaaaaaatatcccgctaccatcaagctggccctgggcggtaccattttcgcctctgtggtgggcatattggcgggcatcgtttccgctgtgaaacgaaataaacttaccgataacataatcatggtcttatccctgatttccgtgtccacgccttcgtttttcctggctcttgtgttgatgctgtttttctccctgcagctgggatggttgcctagtatggggctgcgcacgcccctgcattacgtgctgcccatcattaccctgggtatgcagtccgtgggtaccatcgccaggaccacccgttcctccatgctggaggtgctggggcaggattatatccgcacatccagatcgagaggtatacccgaacgggtaatcatatattcccatgcctttaagaacgccatcatccccgtgctgaccattgtgggcctgcgctttggcggcctgctggccggctccatgctggtggaaaccgttttctccatcccgggcatcggccgctatctggtggacgcggtgctggagcgggattatcccgtggtgcaaagcacggtgctggtgctggcctgtacctttgtgctggtcaacctgatcgtagacctgctctacgcggtggctgacccgaaaatccgttacgaatag

SEQ ID NO: 2261 - DNA, 2181 bp, Unknown; identical to SEQ ID NO: 2099
  Artificiall/Consensus sequence

SEQ ID NO: 2262 - DNA, 807 bp, Unknown
  Artificiall/Consensus sequence
gtgaaaaagctgcgctccttcttcaagggcacctacctgggcctgatgctcctcttcctctacgcccccatcctggtgctgatggtctattccttcaacgaggccaagaccatgggcaactggaccggcttctccctcaagtggtaccaggccctgttcgcggattccaccattatggacgccctgtgggtgaccctgtccgtggcggtgatctccgcactggtggccaccatcctgggcacctttgcggccatcggcctccactccatgaaaaaacgccgccgggcggtgatcgaaaacatctcccagctgcccatggtgaacccggacctggtgacgggcatcagctttatgatgctatttgccctcatgggcattcgggatggctatacccgtatgctcatcgcccacattacctttaacatcccctatgtgatcttttccgtgctgcccaagctgcgccaaagctctaaccggctctatgaggctgccatggacctgggctgcaccccctggatggccctgcaaaaggtggtgatcccggatattatgccgggtatcgtttccgggttcatcctggcctttaccctgagcctggacgacttcgtggtgagctggttcgccacctcgggcatccagaacctgtccatctatatttactccattgcccgccggggcatcagccccaagatcaacgccctgagcaccttgatgttcgtggcggtgatcaccctgctgctgatcgtgaacctgcgcagcctcaaggaggaacgggaagccgaaaaagcagccgctaaacgcctgtaa

SEQ ID NO: 2263 - DNA, 1353 bp, Unknown
  Artificiall/Consensus sequence
ttgattgacgaggtgtatttgtatgttgttattttccagcataccatccatggataccttggccgccgggcattagcccggcggcctttcatattgcaaaaattacttggaggaggcaaaaacagcatgggcgttgtacataaatacggcggcagcagcgtggctacccccgcccacatccgggcggtcgccgcccgggtagcccgggcatatcagcagggggagaagatcgcggtggtggccagcgccatgggcaagagcaccgatcagctgatcgccctggccagccaggtgggggagaatatctgtccccgggagatggacgccctcatggccaccggggagcaaaagaccatttcccttttggccatggccctacaaaacctgggggtgccggccatgtcctttaccggcgcccagtgcggtatgctcaccaacaccaaccactcccgggccaagatcctacagatcaaggcggacgcggtggaagcctgcgtggcggcgggcaaggtgccggtggtggccggcttccagggggtcagccaggacggctccatcaccaccctgggccggggcggctcggataccaccgccgtggccctggccgcggccctgggctgggattgccagatctatacggacgtggactccatcttcaccgcagacccgcgcaaatgcccgggcgccaagcccttgcaccgggtcacctacgaggagatgatggagatggcctctctgggggccggggtgttggagacccgcagcgtggagctggccaagaaatacggcgtgaagctgtatctgggccgttcattggaagaggacctgaggaaaggaacctatatcatggaatggaatgaaacctttgaggatatgccggtcacgggacttagcatcaaggaaaactgcgccatgttcaccatagacggcctggcaccggatggcagcggggtaagccggatctttgaattggtggcggagctggacgtaaacgtggatatgatctcccagcagaccctgcccagcggggtgctggcctccttcagctgctcggaagcggacgccaagctgctgctgggccggatggaggcgggcggcttcccccggcagcccctgcatcaggggaccctgacaaaactctccctggtgggggtgggaatgcgtacccatgggggcatcgccgccgccgcctttaccgccttgacccaggcgggcatcccctattaccaggtgaccacctcggagatctccatctccctcaccgtggaccaagcgaatcaggacaaagccatccgggtattggcggataccttccagctccgggacgaccagctggaagcccagcaggcgtga

SEQ ID NO: 2264 - DNA, 984 bp, Unknown
  Artificiall/Consensus sequence
caatcgtaccaggcgccgtatccgccggaaaggatccacatgaaaccctccttggacaaaaatcaattggtgggcatggggtgttccctgatcgcccatattttctttggttttagctttatcgccgtacggctgggggccacggcctcctcccccctgaccctgctgagctggcggtttttcctggcctttgtggccatggagctgtgcaagcggctggggatcttccacatcgacctaaaagggagatccttaaaacccctgttcctcatggtgctcttccagcccctcctgtattttaccgccgagaccctgggcattcaaatgaccagcgccagcgaaagcggcaccattatcgccaccattcccctgctcacccttttgctcatgcccgccctctcccgggaatatcccacccggcggcaatggatcagcatcgccgtatccgtgtgcggggtgatcctggtgggcgctaccaagtgggcggacgccacctttaacctgctgggctacggcctgctgttcaccgccgccctcagcgacgccatcttcctgaacctgacccgccgcaacgcccagttctccggggtggaacaatcctatatcatgttcggcttcggcgccctggtctttaccatcgccgccctgctggaacacagcctgaagggcaccctgcaggcgttcctgcttctgcccttccaaaaccttggctttttgctgggctgcctgtatctttccgtgggctgttccgtcatcgccttcgtgctgcgcaacgtgggggtggccaagctgggccccggccgcaccggcagcttcagcggggtcaccaccctggtgagcgtgatctccggcgtgttcctgctgggcgaggacttttccctgctccagggcgtgggcaccctattggtactgctgggggtatacggggccaacagcctgccccggggccaccggcaagtgcagatcggaggcgatcccgcatga

SEQ ID NO: 2265 - DNA, 606 bp, Unknown
  Artificiall/Consensus sequence
ttgtacaatattgccggccaagagatcggcacggtgaagctcagcgatgagatcttcgcccaggaagtcaaccaggccgccctccatacggtggtgcgtgcgtatctagccaaccagcgccaaggcacccaaagcgccctgacccgcgcggaagtcagcggcggcggcatcaagccctggcggcaaaagggtaccggccgtgcccggcagggttccacccgctctccccagtggcgccacggcggcgtagtgttcgcccccaagccccgggattatcgggtaagcgtcaacaagaaggtcaagcgtttggccatgaagagcgccctttcctccaaggtgaacgacggcagcctcgtggtgttcgacgccctggagctggccgcccccaagaccaaggaaatgatcaaggtgctggacgccgttaaggtgaacaaggccctggtggtcctccctgaaaaggacgagaccgtggagcgggccaccggcaacatccccaacgtgaagaccaccctggtgggcaccctgaacgtttacgagatcctcaagtacgatacgctgatcctcaccaaggattcgctggccaagatcgaggaggtgtacgcataa

SEQ ID NO: 2266 - DNA, 381 bp, Unknown
  Artificiall/Consensus sequence
atgggttacatgaaagaaaaagtggcgtatcttaggggccttgccgaaggcatggagatcggcggggacaaccagggcaagctgctcaagctgatgatcgagaccatggatgaaatggccgcgtctttggatgataatgagctttccctccaagagctggacgagtgcatcgacgatatctacgaagagctggataccatcgaggactatgtgttcgaggatgaggaggatgacgaggacgaagactactttgacgatgaggatttcgtggaagtggaatgtccccattgcggcgaaacggtgtatttcgaccaggagatgctccagggcgacgacctgatctgccccaactgcaacgagaccattctgcccaaagattga

SEQ ID NO: 2267 - DNA, 2556 bp, Unknown
  Artificiall/Consensus sequence
atggcaaccttcaccgtaaacggtcagaccgtgaccgtggaacaaaatcaaaaactcatgcgctatctgcgggacaccctgcacctgacctccgtgaaggacggttgcagcgaaggcgcttgcggcacctgcaccatcctcatcgacggcaaggccgtcaaatgctgcgttcagcagaccgaccgcatggagggcaagaccatcctgacggtggaaggcctttcggactttgaaaaggacgcgtacacctatgcctttggcgaggcaggggccgtgcagtgcggtttctgcatcccaggcatggtcatgtgcgccaaggccctgctggatcaaaaccctagccctacccggcaggagatcgcccacgccctgcgcaataacatctgccgctgcaccggctatgtgaaaatcatggacgcggtggagctggccgccaagattttgcgggaaggcaagatcccccaagcaccccaggaatggaaggtgggcgcccgggtacaccggctggatgtgcgggaaaaggtgctgggctatggggaatataccgacgacctgtacctgcccggcatggtccatgccagcgccgtgcgctccgcctacccccgggcccgggtgttggccatccataaggaagaagccctggccttacccggggtattgggggtgttcactgccgacgatatccccggcctggtaaaggtgggccacctgaagcgggattggttcgccctggtgcccgttggggagatcacccactacctgggggacgccatctgtttggtggtggcggagaccccggagatcctccagcaggccaaggccctggtgaaggtggattacgaggcgcttgtacccgtcacctgcccggcggaagccatggcggacgacgccccccagctgcatcccggcggcaacctgctggcccataagcaggtacaccggggagacgcccgcaaggccatcgccaattcccgctatgtggtgggaggcaccttccataccccctttacggagcacgccttcctggagccggaatgcgcggtagccctgcccaagggggacggggtgctgatctacacctcggaccagggcacctacgacacccaacacgaaaccgcccccatgttggccatgggcaaggagcaggtgatggtggaaaacaagctggtaggcggcggctttggcggcaaggaggacgtaacggtgcagcaccatgcggccctatgcgccctgttgaccggccggccggtgaagtgcaagctcacccgccaggaaagcatcctgatccatcccaagcgccaccccatggatatggaattcaccctgggctgcgatgaaaacggcatcatccagggggtaaaggccaaggtggtggcggataccggcgcctacgccagcctgggcggcccggtgctggagcgggcctgtacccatgcggccggcccctacaactatcaaaacttcgagatcgacggctatgcctggtacaccaacaatccgcctgccggagccttccggggctttggggtgacccagacctgctttgccattgagaccctgctcaacgaaatggcggaaaaagtaggcatctccccctgggagatccgctaccgcaacgccatccgtcccggccagaccctccccaacggccagatcgtagacgactccaccggcttggtggagaccctggaggcggtaaaggagcaattcgaaagcgccaaatacgccggccttgcctgcgccatgaaaaatgccggcgtaggcgtgggcattccggataccggccgggtgcggctctatgtgaaggacggtaagctggagatccacgcaggggccagctgcatcggccagggcctgggcacggtgctggtgcagatcgtatgcgaggctacggggcttccccgggaacaggtggtctatatgcccgccaacacctacgattccccggacagcggcaccacttccggttcccgccagaccctcatcaccggcgaggcggcccgccgggcctgcctgttgttcaacgacgcccggtacgaccgctccctttcggagatggacggggaggaatattacggccattacctggcccgcaccgaccccctgggcagcgataagcccaatcctgtcagccatgtggcctacggctacgccacccaggtggccatcctgggggaggacggcaagctgcaaaagctcatcgccgcccacgacgtgggcaaggcggtcaatcccctgtccgtggaaggccagatcgaaggcggcgtggtgatgagcatgggctttgcccttacggaagcctatcccctggaaaactgcaagcccacggccaaatacggcacccttggcctgttccgggcggatatgatcccggaggtccaggcggtcatcgtggaaaagcctggcatccgccaagcctatggcgccatcggtctgggcgagatcacctccatccccaccgcgcctgccattgcggaagcctactaccaattcgacggcaagcggcgccattccctccccctggcggacaccccctacgagcggaagaagaagtaa

SEQ ID NO: 2268 - DNA, 2211 bp, Unknown
  Artificiall/Consensus sequence
atggagctgacgggtacggtgaaggccattatatatcgcagcgaggataccggtttcaccgtattggagctgaccaatgaagccggcgaggacatgaccgccatcggggaaatgcccttggccggggtgggggaacgggtggaattgacgggccaatggacggagcacaagacctatggccgccaattccgggccgagacctgtaagaccctggcccccgccacccttacggccctgaagaattaccttgccagcggcctgatcaaaggggtgggggaaagcactgcccaagccattgtacagacctttggcatggagaccctggacgtgctggaaaaggagccggcgcgcttggcggaggtgccggggatcggccagatccgggcccagaccattggcgcttcctatggggcccagctggggctacgggatatcatgctgggcctgcaaaaatatggggttaccatcggccaggccatgaagctgtataaaatatatggggagctctgcctggcaaagatcgaggagaacccctatcggctcatcgacgatgtggaggggatcggctttaagaccgcagacgccatcgcccgcaacggcggggtggagccggacgccccctaccggcttcgggccgggctgaaatataccctgcaatgggcccggcaggaggggcatacctacctgcctcgggaaaagctggtggaggtggcggccgggctgcttcaggcggagatcgcgccggtggagcgcaccctgacggagctgctgctggagggccagctgatccaggagcagcttccgggagaggacgggatatttttacccggcatgttccgcaccgagcaggattgcgccctgcggctattgcggctccagggccaaagcgccctggacaatccctttttccggcccaaggcccagatcgcccggctggagcagcagctggatattaccctggcgccggcccagcgccaggctgtggaattggcgttaaaagcgggggcgttggtgatcaccggcggccccggcaccggtaaaaccaccattttgcgctttgtgatcacccttttggaggagatgggcacggaatatgccctgtgcgcccccacggggcgggcggccaaacgcatgggagaggccaccggtcgggatgccagcaccatccaccggctgctggaatacagctatggggaagggggctttggccggaacgcggagaacaccttgctggcggatgtggtgattgtggacgagatgagcatggtggacgtgcccctcatggccgccttgcttcgggccctggccccgggcacccggctgatcatggtgggggacagtgaccagctgccctccgtggggccggggaacgtattgcgggatatggtggattccggccagatcccggtggtgcgccttacggagatcttccgccaatccggccgcagcgccatcgtcaccaacgcccaccggatcaacgagggccagatgcccatcctggagggcttggaggatttcggctttgagcccatggaggaacaggaggcggtgatccgccggcttattgccctcaatagcggcaaggccgcaaagctgggcgcccaggagccgttgcaggatatccaggtgttagcccccatgaaaaaaggccccttgggggtctataatttgaataagcgcttgcaggaggccctgaatccccccgcccataagaagaaggaacgcaaatatggcgacgtggtgttccgggaaggggacaaggtgatgcagatcaaaaacgactatcgcctggcctggacccgcagcctgccccatcagcccccggagatgggagagggggtgtacaatggggaccttggcaccatcatgtccatcgacctatatgagcagaccttggaggtgctctttgacgacggccgcagcgcggtctatagcttctccatgctggaggagctggaattggcctactgcatctccatccataaaagccagggcagcgaattccccatcgtgctgctgcccctgctgggcggcccgcccatgctgctcaaccggaacctgctgtacacggcggtgacccgggcccggcatatggtctgcatcctgggccggcaaagctgcatccagcagatggtgcgcaacaaccaggtgaagcgccgctatagcggcctagcccggttcctgtgccggcaaaaggagctgctgccatga

SEQ ID NO: 2269 - DNA, 1176 bp, Unknown
  Artificiall/Consensus sequence
atggattacgcaaaagaaagcctgcgcctgcaccaagcctggaaaggcaagattcaggtaaacgccacggtgcctgtggccacccgggaggacctgtccttggcctataccccaggggtagcccagccctgtctggagatccagaaggaccccagcctcagctatacattgacccggcgttggaacctttgcctggtggtgtccgacggcacggcggtgctgggcctgggggatatcggcccggaggccagcatgccggtgatggagggcaaatgcgtgctatttaagtcctttggggatgtggacgccttccccatgtgcatcaaaagcaaggatgtggacgagatcgtcaacaccatttacctgatttccggttcctttggcggggtaaacctggaggacatcgcagccccccgctgctttgagatcgagcgcaagctcaaggaaaaatgcgacatccccatctttcatgacgaccagcacggcaccgccgtcatcaccctggcgggcctgatcaacgccctgaaggtggtgggcaagcccaaaggatctgtccgcatcgtcatcaatggggcgggggcggccagcatttccattgcccgattgctgctttcggatgggtttcaacacatcaccctgtgcgaccggcagggagccatctacgcaggccgcgcccaggggatgaacccctttaaagaggagatggcccagcgtaccaatctggatatgtgcaagggcagccttgcggatgccatgcagggcgcggatgtgttcattggggtatccgcccccggcaccgtgacccgggatatggtagcttccatggccaaggacccggtgattttcgcctgcgccaaccccaccccggagatcttcccggatgaggccaaggccggcggtgcggcggtgatcgccacgggacgcagcgacttccccaaccagatcaacaacgtactggcattcccggggattttccggggcgccttcgacgtgcgggccaaggatatcaacgaccaaatgaagatcgccgccgcctatgccctggctgccctgatctcccccgaggagctatccgccgactacatcatccccaaggcctttgacccccgggtgggcaaggctgtggccgctgccgtggcccaggccgcccgggacagcggcgtggcccggatctga

SEQ ID NO: 2270 - DNA, 882 bp, Unknown
  Artificiall/Consensus sequence
atggaagagatcgccaagcgcggctatctccacgaggattttcgtctgttccatatccgggatcaggtggagctggagctgcattatcattatcatgaattcaataagatcgtggtattcctctccggcaaggtcacctatgtggtggagggcaagtcctatttcctccagccctgggacgtgctattggtgccccggggccagatccattggcccagcatcgatcccagcgagccctatgagcgcatcatcctttggatcaacagcgattacctggaggcccatagcaccccggaggcggacctgctccaatgcttccgcctggcggaggcccgcaagtttgccctgctccggctggaggccgccgcccggccccagatccggggcctgttgggcgcggtggaggacgccctgatcagccgggaattcggcagcgacctatgggcccggtccggctttttgcaattcatggtggcggtcaaccgcatcgccctgcgggacgccaccaacctggacccggacgccttccgcagcgacccgaaaatcgaggagatcctttcctatatcaacgaaaacctggatgcggacctttccctggacgccattgcagagcggttttacatcagcaaatcctacctgatgcaccgcttcaaggagcagaccggttgcagcgcccacaaatacgtgcggcaaaaacgcctattatgggccgccgccctgatccgggggggggtgccggtggtggaggcgggcaagcgctgcggctttggggattattcctcctttttacgggccttcaagcaggtatttggcgccacccccagtgaagcgggcctgatgaccggggccattccggatcacgggcccacccgctatctataa

SEQ ID NO: 2271 - DNA, 1797 bp, Unknown
  Artificiall/Consensus sequence
atggcagagcttttgcaaggctggaaacgcacacactattgcgccgaacccgcccaggctgaggtggggaaggacgtattgctgatgggctgggcggattcctggcggaatctgggcgccctgatcttcatcgggctacgggaccggagcggggtcatgcaggtgaccttcgaccagagccagctgccccaggcggtattcgacctggccaccaccatccgcaacgaatacgtgctggcggtcaagggcgtattggccgagcgggacgagaagatggtcaacaaaaacatggccaccggccggtacgaggtgcgggccaaggagctgaagatcctcagcgtttccgagacgccccccatctatatccaggacgacctggacgcttccgaacagatccggctcaagtaccggtatctggaccttcggcggccctgtatgcaaaagaacatcatgctgcgccacaaggtggcccaggtgacccgccaatactttgacgagcaggggttcctggagatcgagacccccatcctgtgcaagagcaccccggaaggggcccgggactatctggtgcccagccgggtgcagccgggcaagttctacgccctgccccagagcccccagcaattcaagcagctcttgatgctttcgggctacgaccggtatatgcagatcgcccggtgcttccgggacgaggacctgcgggcggaccggcagccggaattcacccagatcgacctggagatgagctttgtggaccgggacgacgtgctggaggtaaacgagggcttcatcgcccggctgctcaaggagaccttggattacgacgtgcagctgccccttcggcggatcacctggcaggaggccatggaccgctatggctccgataagccggatacccggtatgggctggagctgtgcgatgtgagcgacgcggtgcaaggctgcggcttcggggcctttgcgggggccgtggaggcgggcggcagcgtgcgctgcatcaacgtcaaggggggcgcggaaaagttcccccggaaaaagctggatgagctcacggccttcgtgaagatttatagggccaagggcctggcctggatgggcctcaagcccgatgggctccagtgctcctttgccaagttcctcaccccggagcagatcgaggccatccagcaaaaggccggggcccagcccggggatctgctgctgtttgtggcggacggggataacagcgtggtctacgcctccctgggcgccctgcgccaggaggtggccaagcggctgaacctgatcccggaggatgtgatcgacctgttgtgggtggtggatttccccctgttggagtacgacgaggaggaaaagcgcttcgtggccatgcaccatcctttcaccagccccatggacgaggatatcgcctacatggatacggaccccggccgggttcgggccaaggcctatgatatggtcatgaacggcaacgagatcggcggcggctccatccgaatccattccccggagcttcaggagaagatgttcgagaccctgggcttcaccaaggaggaggcctgggcccggttcgggttcctgatggaggccttcaaatacggcgcgccgccccatggcggcctggcctacggcctggaccggctggtgatgctgatcaccaaggcccagagcatccgggacgtgatcgccttccccaaggtgcagaccgccagctgcctgatgaccaacgcgccggacgtggtggatcaaaagcagttggacgagctttgcctggccctggtgaaaaagggcgaatag

SEQ ID NO: 2272 - DNA, 2781 bp, Unknown
  Artificiall/Consensus sequence
atgagcgaaaccaagttccccctggacgaaagcaagctgcccttctccatcccccgggacgccgtgccccgggagaagatcgtcaagctcgcccggaagatcaccgaccggatccccgccaagatcaagggcatcaccgtggacgatcccgaatattggggcctggccgccctggtcaccgacgaaatggcggacgtggccctaaagatgaacatccgggaccccaagaccctgccggagcttgtaaagcttaccggcaagcccgcggaggagctggagcctctgctggcggagatgagccgcattggcctggtggaatacaactgggagaatgcccgccgggaaaagcagtattccctgccgccctttgtgccgggcagcgcggaatttttcaacatgaaccagcagcagatcgacgaaaaaccccagatcgccgcctttttcgagcggatgaccttcctgcccctggagcacatcaccgccatggtgcccccgggcggcgcgggcatcggtatgcatgtgatcccggtggaaaaggccatcgaaaccgaaaaccaaaccgcggatatcgagcatatcagccactggctgaagaaatacgcgggcaagtacgcggcctccccctgctcctgccgcatgtcccgggcccgcatgggcgagggctgcggcgacgacccggagggctggtgcatcgccgtgggggacatggcggactacgtggtggaaaccgacaagggcggccggtacatcacctatgaggaggtcctggacatcctgaaaaaggccgaggacaacggctttgtccaccagatcaccaacatcgacggggaaaacaagatcttcgccatctgcaattgcaacgtcaacgtgtgcaacgccctgcgcaccagccaattgtttaatactcctaacatgtcccgctccgcctacgtggcggaggtgactgcggaaaactgcgtggcctgcggccggtgcgtggaatattgcccggcaggggcggtgcgcctggggcagaagctgtgcgccaagtccggccccatcgcctatcccaagcaggagctgccggatctggtggagtggggcccggaaaagtgggacatcgactaccggaacaacaatcggatcaacacccacgccaccggcaccgccccctgtaaaaccgcatgccccgcccacattgccgtgcagggctatttgaaaatggcggcccagggccgctataccgaggccctggccctcatcaaaaaggaaaaccccttcccggcggtatgcggccgggtgtgcaaccgccgctgcgaggacgcctgtacccggggtaccgtggaccaggcggtggccatcgacggggtgaaaaagttcatcgcccagcaggatctggaggccgccacccggtatatcccggaaaaggtggtgccaaagctcctggggggcttccaggagaagatcgccatcatcggcgccggcccggcggggctgagctgcgcctatttcctggccctcaagggctatgcccccacggtgtttgaaaagaaccaaaagcccggcggtatgctcacctacggcatccccagctacaagctggaaaaggacgtggtggaggcggagatccaaatcctgcgggagctgggggtagagatccgctgcggcgtggaggtgggcaaggacgttaccctggaccagctgcgccagcagggctaccaggccttttacatcgccatcggctgccaggggggccgcaaggccaacatccccggggaggatagcccgggggtcatgtccgcggtggacttcctgcgttccgtggcaggcggggaagcggacccgatccagggccggtgcatcgtggtgggcggcggcaacgtggccgtcgacgtggcccgcagcgccctgcgctgcggcgcccagcaggtgcagatggtatgcctggagagccgggatgccatgcccgccaccccggaggagatccgggaggcggaggcggaggcagtggccatccagtgcggctggggccccaaggagatctgcgtggaagatggcaggatcaccggcgtggtgttcaagcgctgcctgtccgtgtttgacccggagggccgcttcgcccccgtctatgacgagagcgataccatgacccttccctgcgagcgggtgtttatggccattggccagagcatccagtggggcgggctgctggacggggaaaccgtggagctgggccggggccggagccccgtggcggacccggtcacctaccagaccggcgcggcggatatcttcgtaggcggggacgtgtacaccggccccaagttcgccatcgacgccatcgccgccggcaaggagggggcggtctccatccaccggtttgtccagcccaataccagcctcaccatcggccgggacccccggcggttcatccagctggataagcaggacctggacatcggcgattacgataccgccggccgccaggagcctgcccagccccaggacggggaacgcctttccttccgggacacccacggcaccctgaccgaggagcaggtgcgcagggaaaccgcccggtgcctgggctgcggcgccaccattgtggacgccaacaagtgcatcggctgcggcctgtgcaccaccaagtgcgaattcgacgccatccacctgcgcagggagcggccggaatgcagcaccatggtgcccacggaggataaattcaaggtcatcttgccctatatgctcaagcggaagatgaagatcgtctttggaaagaaggatcataccccccatgcatga

SEQ ID NO: 2273 - DNA, 1038 bp, Unknown
  Artificiall/Consensus sequence
atgttattccaaatctatggggaaaacgccggctatcagctattgggctggttgctggtattcgtggggctggtggtcaccaacgagctggcccggcgcagcaagaaggggggcatcttcttcttcatgctggtgccggcggcgctgacggtatactttgccgccatctacatcggcgcggcccggggcgcggaatgggccctgaccaaccagacctataccaacatgaacagctggttccattatgcaaagctctatgccgccaccgcaggctgcatcggcttcatgatgctcaagtataagtggggcgtgggcaaaaccgaatggttcaaggtgttcccctttgccatcgtggccctcaatatcctcattgcggtggccagcgatttcgagtctggcatcaagggcgcccaggccatgaaggagtttggcgaccggtggtggctctcctcggaaaacgtgtggctctatggcggctggtggaattggctcaacggcatcgcgggcattgtgaacatcctgtgcatgacgggctggtgggggatctattcctccaaaaagcaggaggatatgctttggccggatatgatctggctgtacatcctggcctacgacctgtggaactttgaatacacctatctcaacctgcccacccatgcctggtattgcggcctggccctgctgctggctcccacctttgccagcgccttctggaacaagggcggctggatccagaaccgggccaataccctggccatctggtgcatgtttgcccaggtattccccctgttccaggatcagggcgtgttcgccaccctgcccgtgctgtacgcggacggcgtgatgaaccctgccgtgcggcccacggcggtggaccccaccatgcagggggtcatcgccatcatcgccctggcggtaaacgtattggtgttgacggtgatcatcaagcgggccatcacccagaagaagaacccttacaagaacgagatctttacggataccaaggacttccaggaggccatggcccgggcccaataa

SEQ ID NO: 2274 - DNA, 1362 bp, Unknown
  Artificiall/Consensus sequence
atggaagaaagatccaaacgcaacgtcctacacatcctgctccccagcctgttggccatcgccctgggggtggcggtctggtggggctttgaacaaaaggctgaagcggccgattaccggaacctgacccaaagcatgtaccgccgggcctatggggacctaagcgatagcctgtacgatatggaaagcaatctggccaagctccaagccgtgaacacccctgcccaacggatccttttgctggacgagatctggcggctatccggcagcgcggtaagcagcatgtcccagatcccctccctatttctggataccgaggctttgaaccaattcgtggtgcgggtaggggattacgcccacgccctcaccaaaaagaccatggccggcgaagagctgacccaagaggaagtggatagcatctctcagctgcgggacacctgccataccctggcccaggatacggcccagcgcctggcggagggggacatccccctggaagcggtaacggcagaggatttttatagccagacccaaaccgccgaaaacaccggggaaaacacccaggccgacgcccaggaggacgcaggggtcatggaattccccaccctgatctacgacgggcccttctccgaaagcgcggaaaagctggagcccaagggcctgcggggggaggatatttcccaggaggaggcacagcagcgggcccaggccttcacaggccgcacccttacctgcaacggcttggtggaagcctctatccctgcttatgactttagctattccgacgaaaacggcggctggttggagatccagatcacccggcaaggcggggatatcctatggttcatgtccccatccagcagcaacgtagagggtaggcccccggaagccgaagccggccggtatcgggacgcggccctagccaagctggaggagctggggtatctccacatgcaagccacctatgcccagtactatgggggcgtggcggtgatcaactgcgccgccacccagggggacgtgatcctctacagcgacctgatcaaggtatgggtggaccggcaaaccctggaggtggtgggcatggacgcccgcaattacctattcagccacgtggatagacggctacaggccccggccatctccgcctatgaggcggaagcccgggtctccccccagctggagatccaaagccaggccctggctttgatcccccttaccccggagaccgagcggctctgctacgagttcaaatgcaccatgggcggggatagctatatcctctacatcgacgccctggacggcagtgaagcccaggtgttccgcatcatcgacagtgaggacggcaccctcgtcatctaa

SEQ ID NO: 2275 - DNA, 2622 bp, Unknown
  Artificiall/Consensus sequence
atggacagcaacgtacagtatccccttgtggacagcctggagaccctggaagcggcattcgcccgggtccgccgggcccaagcggtctttgccacctattcccaggagcaggtagaccggatcttcctggctgccgctaccgccgccaacaaggcccgtatccccctggccaaaatggctgtggaggaaaccggcatgggcgtggtggaagataaggtcattaagaaccactatgccgcagagtacatctacaacgcctataagcacaccaagacctgcggcgtcatcgaagaggataaggcctacggcatcatgaagatcgcggagcctgtgggcgtcatcgccgcggtgatccccaccaccaaccccacctccaccgccatcttcaagaccctcctgtgcctcaagacccgcaacggcatcatcatcagcccccatccccgggcaaaaaacagcaccatcgccgcagcccgtatcgtgctggaggccgctgtggccgccggcgccccggaaggcatcatcgactggatcgacgtgccctctctggatctgaccaccaccgtcatgcgggagtcggatctcatccttgccaccggcggccccggcatggtaaaatcagcctattccagcggcaagcccgccctgggcgttggccccggcaatacccccgccatcatcgacgatagcgcggatatccgccttgccgtcaactccattatccattccaaaatctttgacaacggcatgatctgcgcctccgagcagtccgtcatcgccgtggatagcgtatacgccggggtgaaggcggaatttgccgcccggggctgccacttcctccaggaggacgagctgcgcaaggtgcgtaagaccatcctcatcaacggcgccctcaatgccaaaatcgtaggccagagcgcctgtaccatcgccaagctggccggggtctcggtgccggaaggcaccaagatcctcatcggcgaggtggagagcgtggagctttccgaagagtttgcccacgaaaagctctcccccgtattggccatgtaccgggctgcggatttcaacgaggccctggataaggcggagcgcctggtggcggacggcggctatggccatactgcttcggtgtacctgaaccccattacccagcaggaaaagctccacgatttcgctgcccggatgaagacctgccggatcctggtgaacactccctccgcccaaggcggtatcggcgacctgtataacttcaagctggccccctccctcaccctgggctgcggctcctggggcgggaacagcgtttccgaaaacgtgggcgtcaagcaccttttgaacattaagaccgttgctgcaaggagggaaaatatgctttggttccgggtgccggaaaaggtctatatcaagaagggctgcctgcctgtggccctggacgaactcaagacggtcatgggcaagcgccgcgccttcctggtgacggactccttcctctataagagtggctttgccaagcccatcaccgacaagctggatgaaatgggcatcgcccacgcctgcttcttcaacgtggagccggatcccaccctggcctgcgccaaggagggcgcccagcagatgcgcgcctttgagccggatgtgatcatcgccctgggcggcggctccgccatggacgcggccaagatcatgtgggtcatgtacgagcatcccgaagcggacttcatggatatggccatgcgctttgtggatatccgcaagcgggtctacaccttccccaagatgggcgaaaaggcctactttgtggccatccccacctccgcgggcaccggttccgaggtgacccccttcgcggtgatcaccgacgagcagtccggcgtgaaataccccctggccgactatgagctgatgcccaacatggccatcgtggacgcggatctgcacatgagcgcccccaagggccttaccgccgcctccggcatcgatgcggtgacccacgatctggaagcctacgccgccatgctggccacggattataccgacggcctggccctgcgctccctcaagaccatcttcgaatacctgccccgggcctatgacaacggccagaacgacccggaggcccgggaaaagatggccaacgccgccaccatggcgggcatggcctttgccaacgccttcctgggggtgtgccactccctggcccataagctgggcgccttccatcacctgccccacggcgtagccaacgccctgatgatcgaggaagtcatccgcttcaacgcggtggaagcgccgccgaagatgggtaccttctcccagtacgcatacccccataccctggcccggtactgcgaggttgcggactacctgggcctggggggcagcacccaggaggagaagctggagaacctgatccaggccatcaacgacctgaaggcccgggtcggcatcaaaaagaccatccgggattatggcatcgacgaggcggacttcctggccaggctggatgagatggtggagcaggcctttgacgatcaatgcaccggcgccaacccccgttatcccctcatgaatgagatgcggcagatgtacctgaacgcctattacggcacccatgaacccgtttaa

SEQ ID NO: 2276 - DNA, 1110 bp, Unknown
  Artificiall/Consensus sequence
ggcatagcgggatacctgttttacgagcaccggacgtacaaggaagcggtggtagtcagcccgtatgtgacggaagtgaagaagctgagcgactacagcgacgtgataaaaggtacggtcaacgactgcaacgtatacatctttgacagcggcgtagaaggcggcaccatgctgatctacggcggcacccatgcggaggagccggcgtgcaacacagcggcgctgctgttcacggagaacctgaaggtgacccaggggaaggtgatcgtgatcgaccggatcaacaccagcggctccctggcgacccgcatgggagaagcgtatccccggttctacagcattgatacgccgtggggagaaaagaccttccggtttggggatcgagcggcgagcccgttggattcctggccggatcccgaggtatacatccactatcccagcggccagaacctggcgtatgtggacatccggaacatcaaccggaactggccgggcaaggcggacgggctgctgacggagcggacggcgtatgcggccatggagctgatcaagcaggaaggggtggacatgaccctggacttccacgaggcggagctggagtatgcggtggagaacaccatcgtggcccatgagaaggccaacgaggtggcggcgatgacgtccatgctgctgacgagccaggtattcgacgtggcgatcggcatggaattctcgcccacggagctgcacggcctgagccaccgggaggtgggcgacttctcggacgctgcgtccatgctggtggaggtggcggagcccatgctggaccggatccgtggcataacggacgaagagctgctgatgagcggcaaggaccggttcgtgatgaaggcgggcgagcacgggctgctgtacgcgcccatcgacgagaacggttggcccatcgagaagcggatcgcccggcacgtggagacggcgaccaccatcatcgaggtgaacaacatggtgcacccggaccagaccatcctgatcgaggggatcccctcctatgaggagatcatggccaacggccccggggcctactaccatgaccccgccacggcggaccccgcctacgtttactacgattaa

SEQ ID NO: 2277 - DNA, 3924 bp, Unknown
  Artificiall/Consensus sequence
atgagctatgcaacatttgacgcaatcaaaatcggtattgcttccccggataagatccgtgagtggtcttacggcgaggtaaaaaagccggaaaccatcaactaccgcacactcaagcccgagcgcgacggcctgttctgcgaaagaatctttggcccgacaaaggactgggagtgccactgcggcaagtataagaagattcgctacaagggcaaaatctgcgaccgctgcggcgtcgaagtcacgcgcgcaaaggtccgccgtgagcgcatgggccacatcgagctcgccgcgccctgcagccacatctggtatttcaagggcattccttcgagaatgggtctgcttcttgatatcagcccccgcattctcgagaaggttctctatttcgccagctacatcgtcaccgaccccggcgactgcccgctgtcgaagaatcagatcctctcggaaaaagaataccgcgacatgcgcgaaaagtatgaggacgacttcaaggccggtatgggcgcagaggccatcaaggagcttctgcaggagatcgatctcgaatcgctctcgagccagctgcgcgccgaattgaaggacgcttccggccagaagaagcttcgcatcatcaagcgcctcgaggtggtcgagtcgttccgcaagtccaataacgatcccacgtggatgatcatggacgtgctgcccgtcatcccgcccgagcttcgcccgatggtgcagctggacggcggccggttcgcaacctctgacctgaacgatctgtatcgccgcgttattaaccgcaacaaccgcttaaagcgcctgattcagctctcggcgccggatatcatcatccgcaacgaaaagcgtatgctgcaggaagcggtcgacgcgctgatcgataacggccgccgcggccgcgccgtcacaggcgcaaacaaccgtgcactcaagtccctttccgacatgctcaagggcaagcagggacgtttccgtcagaacctgctcggcaaacgtgtcgactattccggccgttcggttatcgtcgtcggcccggaactcaagctctatcagtgcggcgtgccgaaggaaatggccattgagctgttccgcccgttcgtgatgaaaaagctcgtcgaggacggcctggccaacaacatcaagtctgccaagaagatgatcgacaagggcaaggacgaggtctgggacgcactcgaagacatcatcaaggaccgccccgtcatgctcaaccgcgcgccgacgctgcaccgcctcggcattcaggcctttgagccggtgctggtcgaaggccgcgcgctgaagctgcatccgctttgctgcaccgccttcaacgcggactttgacggcgaccagatggcaattcacgtgccgctgtcggcagaagcccaggcagaagcgcgtatgctgatgctctcggcgaacaacctcctgcgcccgcaggacggcaagcctgtcacggttccgacgcaggatatgatcctcggcacgtattacctgacctatcagcgctacgacatcgacgcgtttgagacgctgcatgagattttcccgctgctcgattgcggcaagctaaagcccgaaaagcccatttgggtgaagaacatctgggacgacgcagaagcggcagactatcagatgtaccttcgcacgaagggcgagctgctgcagaacgagacggaccgtcccgagacgattccgggctcttaccagacgctcgagcaggccgtgcaggcgctcgacaagggcgaaattgccgcggacgacgtgatttatatctggaacgtctgggacaaggcggccgatatcaaggaagaaaaccatatcttcgtgcgcaccgtcggcgcttacgccgaagaagcgtataacaacggcggctccaagccgaaggaatacttccacatgttccactccgaggacgaggccatgatggcctattccgacgggctcatcgacatgcacgacccgatcaaggtctggaaggaactcgaggtcgaaggccagaagcagcaccgcatcattgacgcgaccgttggccgcctcatcatcaacgatgcaattccgcagaacctcggctttaaaaagcgcgaaacggtggatgatatgttcgggcttgagatcgactttgtcgtcggcaagaagcagctcggcaagatcattgacaattgtatccgcatcaacggcttcaccctgtcgaccgaaatgctcgacaaggtcaaagcgctcggctacaagtactccacgagagcttccatcacggtctctatcgccgatatggagatcccggagaagaaatacgagctcatccacgaggcggaaaaagaggtcgtcaagatcgaccgccagttcaagcgcggctttatcacgaacgacgaacgctaccgcctgaccgttcagcagtgggagaagtccatcaaggacgtgacggacgcgcttcagtcgaacctgaagcggttcaacccgatcttcatgatggctgactccggcgctcgaggcagtatgaaccagattcgtcagctggccggtatgcgcggcctgatggcagatacgaacggccgcacgatcgaaattccgattaaggcaaacttccgtgaaggcctttccgctctcgagtacttcatttcctcccgaggcgctcgaaagggcatgaccgatactgcgctccgcacggcggactccggctacctgacccgacgcatggtcgacgtgtgccaggatgtcatcatccgcgagtttgattgcggctcgacgaacggcagctggaagggcgactactatgaaaagggtcagctgattgattcctttgcaaaccgcatccgcggccgctatccggtacacgacatcaccgacccgcagacaggtgagctcctgcactccaaggacatcatgctccgcgaggacgacgcgaagaagttcctggcgcatggcatcgacaaggtctatgtccgctcggtgctcggctgcaaggcacgttccggcgtgtgcgcgaagtgctacggcatgaaccttgcaacctccgagcttgtgaaccccggcgaagcggtcggcatcatcgccgcgcagtccatcggcgaacccggtacgcagctgacgatgcgaaccttccacaccggcggcgtcgcgggcgacgatatcacgcagggccttccccgagtcgaggaactgtttgaggcccggaagcccaagaagatggcgcagatctcggaaatcgacggtgtggccgatgtcgacgattcccacagaaccgcgcttcgcaacattacgatcaccgccgacgatggcgaggtcaagcagtatcaggtcccgtattccgtcggtcttaaggtcgagcatggcaagcgcgtgaagaagggcgatcccatcaccgatggcgcactgaacccgcatgacgttctgagaatttcgggcgtcgaggctgtgcaggactatctgacgcagggcgttctcgccgtgtaccgtcagcagggcgttgacatcaacgaaaagcatatcgaggtcatcatccgccagatgatgcgcaaggtgcgcgtggaagagccgggcgatacgaagcttctcagcggcacggtcgtcgatgtgtacgaatttgaagacgcgaacgccgaggtgcaggcacgtatcgatgcgggcgagaccgacctcaagctcgcgaccgacagcctgatcctcatgggcatcacgaaggcttcccttgcgaccgagtcctggctctccgccgcttccttccaggagacgacgaaggtcctcacggacgctgccatcaagggcaaggtcgaccatctggtcggcctgaaggaaaacgtcatcatcggcaagctcattcctgccggcgcaggtctgcaggcctaccgcgacttcgagcccggcgtgacgccggagtcggtggtcacggaagaaatgattgacgacgaaagaatgtaa

SEQ ID NO: 2278 - DNA, 2079 bp, Unknown
  Artificiall/Consensus sequence
atgccaagacaatattcacttgagaatacgagaaatattggcatcatggctcacatcgatgcgggcaagacgacgacgaccgagcgtatcttgttctacaccggtgtcaattacagactcggcgagacccacgacggtacggccaccatggactggatggagcaggagcaggagcgcggtattaccatcacctccgctgctaccacctgccactggaagggcgtccggatcaatatcattgatactccgggtcacgtggactttacggtcgaggtcgagcgctcgcttcgtgtgctcgacggctccgtaacagttctgtgcgccaagggtggcgtggagccgcagaccgaaactgtatggagacaggctgacaaatatcatgtcccgcgccttgtttacgtgaacaagatggacatgatgggtgccgatttctacaatgtcctgaagatgatggacgaacgcctcaagtgcaatgcagttcccatccagctgccgattggcaaggaggatacattccgcggcgttgtcgacctcattaagatgaaggcatttatcttctacgatgatttgggcaaggatatgcgcgaggaagaaattccggcggatatggcggagcttgcgaagcagtaccgcgaccatatgcttgagtccatctcggacgaggacgaagagatcatgatgctctacctcgagggagaagagatccccgagcagatgattaagacggcgcttcggaaggcgaccatcggctacaagatcgtgccggtgacctgcggatcgtcctataagaacaagggtgttcaggagctgcttgacgcaattgtcgagtatatgccgtcgcctctggacaagaaagccatttccggcgtgaacccgaagaccgacgaagaggaaacgcgcgaaccgtccgacgacgcgccgtttgccgcgctggccttcaaaattatgacggatccttatgttggtaagctcgcgttcttccgcgtctactccggtacgctggagtccggcaagaccgtcatcaataccaacaagaaccagcgtgagcgcatgggccgcattctgctgatgcacgcaaaccatcgtgaagatctggactgtgtgtactcgggcgatatcgccgcagcagtcggcctgaaaaacaccacgaccggcgatacgctctgcgacgctgcgcaccccatcatccttgagtcgatggagttccccgagcctgttattcgcgtggccatcgagccgaagacgaaggcgggtcaggagaagatgggtctggcgcttgccaagctcgcggaagaggatcccacgttcaaaacctacaccgatgaagagaccggccagacgattatcgcgggcatgggcgagcttcatctggaaatcatcgttgaccgcttactgagggagttcaaggtggaggccaatgtcggcgcgccgcaggtcgcctataaggagacgattacaaagtctgtcttccaggagaccaagtacgccagacagtccggcggcaagggccagtacggccatgtcaagatccaggtggaacccaacgaaagcggcaagggctttgagttcatcaacaagaccgttggcggctcggttccgaaggaatacattcctgcggtcgaacagggcgtcaagggcgcgatggagtccggcgtgcttgccggcttcccggttgtggacgtcaaggtcacgctgctcgacggttcgtatcacgaggtcgactcgtctgaaatggcctttaagatcgccggatccatggcgttcaaggaggcgtgtcagaaggcaggtcctgtcgtgctcgagccgatcatgaaggtctgcatcattgtcccggacgagtatatgggcgacgtcatcggcgatgtcacttcccgccgcggcacgattcagggcctgacgcagcgcaatggcgcgcagcaaatcgactgctttgtcccgctgtcggagatgttcggctacgcgacgaaccttcgctcccgtacgcagggacgcggccagttcaccatggagcccagccactatgtggagctcaacaaggcgctgaccgaggcggttgtttccaagcgcaagggttattga

SEQ ID NO: 2279 - DNA, 1401 bp, Unknown
  Artificiall/Consensus sequence
atgaaaaaagttcaaatcactgaaactgtccttcgtgatgcgaatcagtccctgatggcaacccgtctgccgtacgccgattttgaggaaattcttcccgaaatggacaaggccggttattattcggtcgagtgctggggcggcgcgacgttcgactcctgccttcgctatctcggcgaggatccgtgggagcgcctgcgcaatatccgcagactgatgcccaacacgaagctgcagatgctccttcgcggccagaacctgcttggctacaagcactatcatgacgacgttgtggaaaagttcgtcgagctgtccatcaaaaacggcatcgacatcctgcgtatcttcgacgcactgaacgacttccgcaacatcaagaccgctctcgaggccaccaagaagtacggcggcaagaacaccgtcgcttccggctgcatctcctacacgcagagcccggtccacactgtggaaaagtacgtcgagatgtgcaaggagctcaagaccatgggcttcgacaccatctgcctgaaagacatggcgggcacgatgagtccctatgaggcagagcacctcatcaagggcatcaaggacgcagtcggcgatatgccgctcatcctccacacccactgcacgaccggtatggcctacatgaccgtgacgaaggccatcgagtccggcatcgacgtcatcgactgcgcgacctcctgcttctccaacggcacctcgcagcccgcgaccgagacgatgttctacgcgcttcagcagtacggcatcaaaactggcctcaacgaggacgtgatcaacaaggtcaacgatttcttcaagcccgtcaagcagaagtacgtcgactccggccgtatcaacgccaagtccatggcgaccgacgcgcaggcgctggtttataaggttcccggcggcatgctttcgaacatgatcgcgaacctcaccgacatgaaggccatggacaagttcgaggccgctctggcagagatccccgccgtccgtaaggacctcggctatcctccgctggtcaccccgctgtcccagatggtcggcaaccaggccgttaccaacgtcctgctcggccagcgctacaagcaggtctccaaggaagtcaaaaactacttcaagggcgagtacggcattgcgcccgctcccgtttccaaggagctcgagacgcagatcctcggcgagggcggcaagcctgttgactgccgcatcgaagacgcaaagcgcaccggtgaggacttcaagaaggccaaggaagcgctcggcgatcttgcaagaagcgaagaagatatcatgagctacatctgctatcccgatcagaccatgaagttcctcaccgaccgcaaggccaaggaagagaacatctgcaagtactcgatcgtcgaagcgtaa

SEQ ID NO: 2280 - DNA, 2139 bp, Unknown
  Artificiall/Consensus sequence
gtgcgcggattgcgcgcggaaaaggaggatgcagacatgagtgaactggccaatcgaattcctgccctgtttggcagctgcgtatttaatgaggagacgatggagcagtacatccagtcctccgccatggacgcatggcgctcgtgtttgcaggagggcaaggcgctgagtctcgccgtcgccaacgacatcgcggacggcatgaaggcctgggccttagagcacggcgcgacgcattttacccactggttccagcccatgaccggctacaccgccgaaaagcacgacagctttatttctcccgccggacacggccggattgtcatggagttttctggcaaggagctcgtgcgcggcgagccggatgcgtccagcttcccctcgggcggcctgcgtgcaacgtttgaggcgcgcggctataccgcgtgggaccccacggcctacgcctttttgaaggacaacacgctctatatcccgacggtcttcttctcctactccggagaggcgctcgataaaaaaacgccgcttctgcgctcgatcgacgcgatgagccggcaggcggtccggattctccgcctcttcggcgacacgaagaccaaaaaggtttcagcaaacgtcggccccgagcaggaatatttccttgttgataaggagctctatttaaagcgcgaggaccttcgcatgtgcggccggacgctcttcggcgcaaagccccccaaggggcaggagctggacgatcattactacggctccattcgcccgcgcgtgacggcctatatgcaggacctggacgaagagctctggaagctcggcatctactccaagaccaagcacaacgaggtcgcccccagccagcacgagatggcccctgtgtactgcgactgcaacacagcctgcgaccagaaccagctgacgatggatatcatgaagaaggtcgctgaccggcacggcctcgtctgcctgctgcatgaaaagcccttcgcgggcgtaaacggctccggcaagcacgacaactggtctttatccaccgactccggcgaaaacctctttgcccccggcaaaacgcccagccagaacgcgcagtttttgctgttcctcacggccttcattgagggcgtcgacgagtatcaggagctgcttcgctcgacggttgcgtttgccggaaacgaccatcgcctcggcgcgcaggaagcgcctcccgccgtcatttccatctatcttggagacgagttgagcgacgtcattgactccatcatcggagagaccgactacaccgaccgcaaaaagggcgcgcttcgcatcggcgtggacgttctgcccacgattccgcaggacacgaccgaccgcaaccgcacctcgccccttgccttcacgggcaacaagtttgagttccgtatgctgggctcgagccagtccatttccgggcccaacatcgtcctcaacacgatcatggcagaatcgctccgcaaatacgcggacgttctggaaaaggccgagaattttgagacggcgctccacaccctgatccgcgacgcgctgcgcgagcaccgccggattttatttaacggcaacggatatgagggaagctggctcgaggaagccgcgcgccgcggccttgcaaacctcgtctccaccgccgacgcgctgcccgcgttcattctggagaagaacattgaccttctgtcccggcacggcgtgttcagccgcagcgaaatgatggcgcggcacgagatccacatggaaaactacagcaaggttatcaagattgagacctctacgctcatcgacatcgtccagcacacgctgttaaatgccgcaacggcttatacgcgcgatctttgcaccacgattttgcagaagaaggccgcgcttccgggcgaaacctgccgggtggagtccgcgctcgccgcgtccgtcagccggttgggagaagacctgctcgaccgctgcgccgcgctcaagaccgcgctcgacaccatgcccagggaccttgacgcggaagctgagatgcactactgccacgaccagttagtgcccgccatgggcaaggtccgcgagacgatcgaccatctcgagacactcgttgccagcccctattggccggtccccacttattgcgatttacttttctctgtttaa

SEQ ID NO: 2281 - DNA, 1971 bp, Unknown
  Artificiall/Consensus sequence
ttggattataccaagtacgtgttaaagagccaggaagagcttgaaggcatgctggcggggaaggacaatctcttcgtcgtcgcctgcaacaagtgcttcaaagagttcgaaaccacgcaggagccggattgcggctgctttaccgccatcgctgaggcgcagggcaagcacatcaccggttctgtcaaggtagacttcctgtgcaacaaggtccagaccgaaaaaacgcttgcaggccttgtccccgagggaacggaaaacgttgttgtcgtttcctgcggactgggcgtgcagacggtggccgatcttgctgcggttcccacgtttaccgcaaccaattctctgaattatgtcggccatcatggcatggcgctcacgaagaagacctgcggcgcctgcgcccagtgctatctgaacgcgacaggcggcatctgtcccatcgtggactgctcgaagagtcttgtcaacgggcagtgcggcggcgcgaaaaacggcaagtgcgagatcgatcccaaaaaggactgcgcttgggagaagatctatcagagactcgaaaagcagggtcggacgaaggaattcctgaaccagccggtgcagctgcgggactactccgtggctagcgtcgatgagatccaggcctacgtcgccgaagccagagccagacgctttgagggcttctacggcggcgtgcatcccaccgagcacaaggattataccgagcatctggcgctccagaagttcccggagcccgatactgtcattctgccgctcgccatgcacatcggcgcgcccgcaaatccggttgtgaaccccggcgactatgtgaaggtcggccagctcatcggcgagcaggcgggctttatcggtgcgcccgttcactccagcgtcagcggtacggtcgtggctgtcgagccgcacacgcatccgaacaagggccccggcattctgagcgtcgttatcaaaaacgacggcaaaaacgtgctccatgaatccgtcgttcccaacaagcccctcgaggagctgacggccgacgagatcatcgagatcgtcaaggaaaagggcatcgtcggcatgggcggcgcaacgttcccgacctatgtcaagctgaagcccggcaagcccattgacgcggttctcatcaacggctccgagtgcgagccctacttaacggcggaccaccgcatcatgcttgagtacgccgacgacatcgtcttcggcctgcgcgccatgatgaaggccgtttccgcgcccgagggcgtcatcctcatcgaggacaacaagcccgacgccgtggcgctcatggaagagaaagtcgcgccctacgataacatccgtgtggtcgctgccaagacgcagtaccccgagggtgctgaaaagatgctcatcaagaaggtcatgggccgtcaggttcccagcggcaagctgccggcagatgtcggctgcgtcgtgagcaacacctcgaccgccaaggccatttccgacgcgatccagaagggcatgccccttgttgagcgcgcggtatccgtcacgggcgacttcatccgaaaccccggcaactacatggtcaagctcggcaccaacgtccaggagatcatcgaccactgcggcggcgtgacgggcgaggatatcgtcctcaagatgggcggccccatgatgggcgctcccatcaatgacaccaacgttcctatcatcaagggctccaacggcatcatcgccattgccgccgaccacacggaggaaaaagagtgcatcaagtgcggccgctgcgtagacgtctgtcctatggagctgaagcccttggaattctacaagtacggccagctgggcgacgcggagaagcttttgtctctcaacatcatggactgcttctcctgcaagtgctgcgagtacatctgctcgtccaagattcctctggtatcgaaaatcaacgccgccaagggtctggtcatgcccctgctgaagaagaaataa

SEQ ID NO: 2282 - DNA, 3306 bp, Unknown
  Artificiall/Consensus sequence
atggacggcaacaatgctgcggctcatgtatcctatgcgtttactgaagtcgcgggcatttaccccatcacgccgtcgtcccccatggcagacctggttgaccagtggtctgctaccgggctcaagaacatcttcggctccaccgtcaaggtcgtcgagatgcagtctgaggccggcgcatccggcacagtgcacggctccctcggcgccggcgctctgaccaccacctacacggcgtctcagggtcttctgctgatgatcccgaacatgtacaagatcgccgccgagcagctgccctgcgtgttccacgtttcggcacgtaccatctcgacgcacgctctgaacatcttcggcgaccattccgacgtgatggcttgccgccagaccggcttcgccatgatgtgcgagacgaacccgcaggaagtcatggatctggctcccgtcgcgcatctggccgcgatcgaaggcaaggttccgttcctgaacttcttcgacggcttccgtacctcccacgagatccagaaggtcgctgtctgggactatgccgacctcaaggaaatgtgcaacatggaggctgttgcggccttccgtcagcacgcgctgaaccccgagcatccggccatgcgcggctctcacgaaaacggcgatatcttcttccagcaccgtgaggcctgcaacaagttctataacgagctgcccgcagtcgttgagaagtacatgggcaaggtcaacgaaaagctcggcaccaactatcagctcttcaactactatggcgcgcccgatgctgaccgcatcatcatcgccatgggctccatctgcgacgtggcagaggaagtcatcgactacatgaacgcgcacggcgagaaggtcggtatcgtcaaggtccgtctgtatcgtccgttctgttccgacaagctggtcgcggccatcccggcaaccgccaagaagatcgccgttctcgaccgcaccaaggagcccggctccctcggcgagcccctctacatggacgttgtcaccgcacttgccaacgccggcgtgcaggctaccgtcatcggcggccgctacggtctcggctccaaggacacgccccccgcatccgtcttcgctgtttacaatgagctcaagaaggatcagcccaagcacgagttcaccatcggcatcgtcgacgacgtcacgaacctctccctcgaggaagaccgcaactgcccgaacaccgcagcagaaggcaccatcgagtgcaagttctggggtctcggcggcgacggcaccgtcggcgcaaacaagaactccatcaagatcatcggcgaccacaccgacaagtatgtccaggcctacttccagtacgactccaagaagaccggcggcgtgaccatcagccacctgcgcttcggcgacaagcccatcaagagcccgtactacatcaacaaggctgactttgtcgcctgtcataacccgtcctacatcaccaagggcttcccgatcgtccgtgacgtcaagcccggcggcgtgttcatgatcaactgccagtggacgccggaagagctcgctcatcatctggacgctgcttccaagcgctacattgcaaagaataacattcagctctacacgatcgacgccattgatctggcacagaagatcggcatgggcaagcgtaccaacaccatccttcagtccgcgttcttctcgctggccaaggtcctgcccgaggcagaggccatccagtacatgaaggaaaaggcaacgcagtcctactctaagaagggcatggacgttgttgagatgaaccacaaggccatcgatgccggcgctactgcgtacaagaaggtcgacgttcctgccgactgggcaaatgcagaagacgttgctgccgaccacaagctcgaaggcaagccggagcttgtcaagcaggtcaagaacctcctgttcccgatcgacaagatggacggcgacagcctgcctgtttccgcgttcatggatcatgtcgacggcgagttcgagcttggtgctgccgcttacgaaaagcgcggtgtcgccgttgccgttccgacctgggactccgcaaagtgcatccagtgtaacaactgcgcttacgtctgcccgcacgcgaccatccgtccgtttgcgctgaccgaagaagaagcaaagaatgctcccgcagctgccaagatcgttccggtcaaggccggcaagggcaagggcgtttatcagttcaccatggccatctccccgctcgactgcatgggctgcggcgtctgcgtcagcgtctgccccgagaaggttcaggccatcaagatggttccgcaggaagaagagctcgcccagcaggatgtgttcgactactgcgtttccaaggtttccgagaagaaggaactccagactgccgacgtcaagggctctcagttcctcaagccgctgcttgagttctccgtctcctgcgcaggctgcgccgagacgagctacgcacgtctggtcacgcagctctacggcgaccgtatgtatatctccaacgctaccggctgctcgtccatctggggcggtccgggcgctacctctccgtactgcacgaacgctgagggtcagggtcccgcatggtgcaactccctgttcgaagacaacgccgagcatggcttcggtatgtacgtcgcacagaaggcaatccgcacgcatctggctgacctcaccaagcagctcatcgctgtcgactataccgacgccgatctgaaggctgccgcgcagaagtggctcggcaccatggaagacggcgacgcgaacaaggccgctaccaaggcttatgtcgcagagcttgaagcttccgtcatttccggctgcgattgcgacgcctgcaagctgggcgctgaaatccttgccaagaaggattacctctccaagaagtccgtctggatcttcggcggcgacggctgggcatacgatatcggcttcggcggtgtggaccatgttctcgcttccggtgaagatgtcaacgtcttcgtcttcgataccgaggtttactccaacaccggcggacaggcttccaaggcttccaacatcggtcaggttgcgcagttcgcagctgccggtaaggaaaccaagtcgaagtccctggcggagatcgccatgagctacggctatgtctacgtcgcgcaggtcgccatgggcgccaacgccgcgcagaccctcaaggccatccaggaagcagaagcttaccatggcccgtcgctcatcatcggctacgcaccctgcgagatgcactccatcaagggtggcatgcagaactgccagaccgagatgaagaaggctgtcgactgt

SEQ ID NO: 2283 - DNA, 1779 bp, Unknown
  Artificiall/Consensus sequence
atggatatggagccagacatgagtatttcaaatgtgatttctctgctcagcggtatcgcactgttcctgttcggcatggcgctgatgggagacgggctgaaaaaagtcgcgggcaacaagctggaagtgatcttatatcagttgaccggaaagcccctcaagggctttttgcttggtacggcggtgacggcggtcatccagtcgtcgtcggcgacgagcgtgatggtggtcggctttgtcaactccggtatgatgcgcgtgcggcaggccatcagcatcgttatgggcgcgattctgggcacgagcatcacgggctggatcatctgtctttccgacctcggcggaggcggcgggtggatcgaccttttttccacggcgacgctcacgggggtcatttccgtggtcggcattgtgcttcgcatgttctccaagaaccagacgaagcagcacgtgggcgatattctcatgggcttcgcggttctgatgttcggcatgtcgacgatgtcggcggcggtgtctccgctgcgcgacgagccggtcttccttcgcatcctgacctcgttctccaacccgctgcttggcattttatttggtacgctctttacctgcgtgctgcaaagcgcgtcggcggcggtcggcattttgcaggcgctggcatctacgggcgtgatcgatttttccatcgcccttcccatcatcatgggcattgccatcggcgcggcgctgccggtgcttctgtccgcagtcggcgcgaacgttgacggcaagcgcacggccatggtctatctcgtggtcgaagtcgcgggcgttgtgttctgggcggcggctttttatctcgcgaacgccgtgttccggttcaattttatggatatgccgatgacgagcgtttccatcgcgtttgtcaacaccctcttccgctttgtgaaggtcgtgatcctgctgccgtttacggatgtgattgaggcagttgtgaacgcgctcgtcaaggacaagggcgaggaaaagaacgccaacgagcccgccgcgatgcacctggaagagcgctttttgcagcacccggcgcttgccatcgagcagagccgcatcacgatcaactccatggccgccgacgcggagctcaacttctcgggcgcgctggcgcttctggaaaactactccgacgaggactttgccgaggtgcagcggatggagggcgtgatcgaccggtacgaggacattctgggcacgtatcttgtcaagctgaccggccgcgagctcaccggccgccagagcgcggacgtttcgaaattcttgcatacgatctccgattttgagcgtatctccgaccacgcgctcaatgtcgccgaggctgcacaggagatccaccagaaggggatcactttctccggcgacgcgcggcacgagctttccgttctgacagacgccctgcgcgaaattctgcacaacgccatccgcgcatttattatggaggaccttgagcttgccaagagagtcgagccgctggaggagctcatcgacgcgctgtgcgacgagatgaagctccatcatgttgacagacttcaaaagggcgtatgtacgctcagccagggcttcgtcttcaacgatcttctgaccaactacgagcgtgtcgccgaccactgctccaacatcgccgttgcgatgatcgagcttgaggcagactcgttcgatacccacgaatatctcagcagcgtcaaggccatgaaatccgcggcctatgagcgctattatgaggaataccggcagcagtttgcactgtaa

SEQ ID NO: 2284 - DNA, 1830 bp, Unknown
  Artificiall/Consensus sequence
atgaaccaatcctcaaccctccgcgcaagtaaaacgaccatcgcgctcaacaaggtcaaaaccttcttttcaaagccccacaacgtcattcttctgctgctgggtatcgttctgaccttcaccaccgtcgcgcccatcgtcgccatcgtggaagacaccttcaagatccacgccggcactatcgacgcgcacctgaccggtcaagcctccggctacaccacggtcaactacattgacctcttcaccagccgcatggccaagacaaacctctggacgccgcttggcaacactgtcctgctcgctgtcggcacgtgcgtcgtctccatcttatatggcggcctgttcgcgttcctcatcacaaggaccgacctcgcctggagaaaatatttaagctccattttcattttcccgtacatcatgccgcagtggacgctcgccgtcgtgtggcagaacctgttcaattccaacgccgttaccggcacgtccaacggtctgcttgccgccctctttggcgtcaacatgccgatatggtggtgcaagggcctgttcccgagcctcatggtccttggccttcactacgcgccgtttgcttacattttaatcggcggcatcttccgcaacatggacgcgaacttagaggaggccgcaaccattctcgatacccccaagtggaagaccatgttccgcatcacgctcccgatggtaaagcccgcgattttgtccacgatccttctcgtcttcggaagcgccatgggctcttacccggttccccattacctcggcctcagcacactctcgacaaaatacgtctcgatgaactccaagtataccggcgaagcgagcattcttgccatcatcatgatgatcttcggcgtggcgatcatgctgctcaaccagctttccttgagaagccgcaagaactacaccaccgtcaccggcaagtccggccagatctccaaaatcacgcttggaaaatacggcaagtacatcatcgccatcattcttgtcatcctcacgttcttcacgagcatcttccccatcatctcgtttgcgtttgagaccttcctcccgaacccgggcgactattcgttcctctatacgggagacgcttcgaacctcacgaccaagtggtggctcaccagcgaaaacgtcactgaaaacggcatgtacggccagaagggcatcttgtataacgagacgatctggcgcgcgttcaagggaacgatcctcgtctccgtcgcctgcgcgctgctcgccggcaccatcggcacgatgatcggctacgccgtctccaaaaaccgccgcagccgctgggcaaactatgtaaactccgtcgcgttcctgccctacctcatgccgtccatcgccgtcggcgtcgcgttcttcatcctgttctcaacggaaaagctgaacctcttcaatacctatacgctcctcatcatcgtcggcaccgtcaaatatatcccctttgccagcaggagcagccttaactccatgctccagctctcgggcgaaattgaagaggccgccatcattcaggatatcccttggatcaagcgcatgacccgcatcatcatccccattcagaagtcctccatcatctcgggcttcctgcttccgttcatgacgtgccttcgcgagctgtcgcttttcatgctcctttgcgtgcagggcttcatcctctcgaccacgctcgactacttcgacgaaatgggcctctacgctttctccagtggtatcaacctgattctgatcattacgatcctcatctgcaacacgctcgtgaacaaagtcaccggcgcaagtctcgacaagggaataggaggttaa

SEQ ID NO: 2285 - DNA, 2667 bp, Unknown
  Artificiall/Consensus sequence
atgagcgaactgaaacggacgattttgtaccaggcacatctcgacgcaggcgcgaccatggtcgacttcggcggctgggatatgcccatccagtatcccgaaggtatcatcgcagagcatctctactgccgccgtcactgcggcatctttgacgtgtcccacatgggacggatcgacgtcgaaggccccgatcaggtagcgttcttgcagcatgtgctttccagcaacgtgcttgcgctcgacctcaatcaggcgcagtactgcatcatcccggacgcgaacggatacgccattgacgacgcgtacctgtaccgctttgaagagggcaagtacttcctcgtcatcaacgccggcaacatcgacaaggactgggcacacctgatgaacgaagcgaagaactttgacgtcaagctcacgaacgtctctgacaagtacgcggccatcgccgtgcagggcccggagtccaagaagatcctcatgacgctttccggcggccgtcagctgacgcccgagaacgtcaagaacgcgctgaacagcctgacgatggaaggcaagcccgtccgcatcgcaaagaccggctacaccggcgagcccatcggctacgagctgtactgcaactcggaagatgcgcggtacttctgggaccgtctcatcgagcttggcgcaaagcctaccgcgctcggcgcacgtgacaccacgcgtatggaagccgcgctcccgctctacggccacgaaatgggcgagtgcgaaatgggcggcgagatccagatctacgccgtgccgctggcaaagttcgctgtttccttcgacgaggccaagggcgatttcatcggccgcgaaccgctcaagaagcagtttgaggcgctcaagaagatcatgaaccgcgactattcctcgatcgaggacctgccgtaccgcatccagcccatctatctcgagggcaagggcgttctgcgtaagggcttcccgatctactgcaaggacgcatgggctgagggcaagcagatcggctatgtcacctccggcaccatgatcccgtattacaagaccgagggccagggtcttgagagcgtcttcaccgacgagaccggcaaacgctcgatcggccttgcttacatggacagccgcatctgccaggacttcgacattgaaatcgacatccgcggccgccgtcagcctgcaaaggtcgtcggctaccatatccgtcaggacgccgcgccctatgtccgcccgatccttcccgatgtgaagatcgaaacggcttctcccagcaccgattcctatcccgagaagatgaagaacctcgtcgccgccgccaagcagaaccatctgtggcgccagaccgagtgcatcaacctcatcccgtcggagaacacgcagtccagagccgtccggatgctctccgcgtccgacccctgcaaccgctacgccgagcacaaaaagcagaaggcgttctacgacgcagagattttctactatcagggcacgggcttcatcgcttccgtcgaggcgatgctcgttgaggaaatgaaaaagttcctcggcgcatcgcaggtagaaacccgcgtcacgtccggtcagatgtcgaacacggcggtgttctcggcgatgatggactttaaaaaccgcgtcgaccgcaagcgcaccccgcagcgcctcggctgggtcatgaacaaccacatcgtccgcggcggccacctctcggcgcagcccatgggcgcgttccacgactacgtcgccatcgaccccgtcacggaaaagcagatggtcgtcaacttcccggtctgcgaggataacccctacaagatcgacgtcgagaagacgaaggttctgctcgcgcagtacaagcccgagttcatcatcttcggtaagtccatggtcctttataaagagccggtcgccgagatccgcaagtttgtcgatgagcagggcatcaagaccaccatcatgtacgacatggcgcatgtgctcggcctcatcggcgatcatttccagaagccgtttgaagagggcgcagagattgtcacgggctcgacccacaagaccttcttcggcgcgcagcgcggcgtcatcggcgtcaactacaagcccgaggacctcaagtggggcctgtgggagaccatcgaaacgcgcaccttcccgggcagcgtctcgaaccaccatctcggcacgctccttggccagctgatggcagcgtacgaaatgaacgcgttcaaggacgagtaccagaaggccgtcgttgaaaacgcaaagcactttgcaaagtgcctggccgccgagggcctcgacgtggcgggcgatcctgccatggattacaccgagacgcatcaggtcattgtcaaggtcggctatgcgcacggccccgaggttgccgatcgtctggaggccaacaacatcgtctgcaactatcaggcgacgcccgaggaggaaggcttctccgcttccggcgcgctgcgtatgggtgtgaacgaaatgacccgcttcggcttcggcaaggaagacttcgcgaagctggcgcacctgatcgccgactgcgtgctgcatcacgcaaacgtcaaggaagaggtcaagaaactccgcgcagagcatctggagatgaagtactgcttctccgacaaggataccgaagagcttctgaacgccttcgcttccgcaacgggcatctga

SEQ ID NO: 2286 - DNA, 2058 bp, Unknown
  Artificiall/Consensus sequence
atgattttggtaggaggaaaaggaatcatgaaaacaagtaaaagattactgagtatcgtcctgatgctcgccatgcttgtgagtatgttcacagtcatggcctttgccggcgataaggtaaaagttacctttgatattggcaagggcggaacagcctcgatcggaaataaaacactgaaaagcagagagtatagcttcacgcttgcggaaatcaacaacgcgtatgtcgttgtgagtcccaagtccggctacgtcgcggacgtgacgatcggcgacacgaagctggatcaggcgcaggcaaactatggcttcagcctgtcgtccgatatggatggcaaaacgatcaagattacctttagcgagaaggatgccggcggagaacccgaacccactcccgatcccgaaccctctacgaatgttaatctgagaatcggcatgtgggcaagcgatgttcagaacgccgaaatcctgcgcgatggcaaagcgcttgacatcacgacagcagtttcctttactcaggaagagctcaatagaggcgttacgctgacagctcgtgcagacaacaaaacgtattcggtcaagtggacgctgaacgaaggtgcgccggtagaaggcaaaacgttcacgcttccgacagacctcaagggtggcagcaagttgtttgttgagtttacggtcgacaccaagccggagcctgaaacaaaacatacgctgacggtttcctcgaaagatgactcgatgggtcttatccagtatggtgagaacgagaagaaatccattgacttcagcctcgaaaagaaggaaaaggttactgtaaaggctgttgccaagaagggttacgagtttgtcgagtggagatcggatgacatcaagcttacccccagccagaagcaggatgccacgctgaaaatcactatgcccgacaatgacgtcaaggttacggctgtgttccagaagaaaactgtttccggagactacaagctgacgctcgacgtgagcagacatggcgacgtttatgagaacagcacaagaggcgacgccgcgaagagctattactggctcgacgatgacgacgagctcaccttcaaggcagttgccgacaagggctacgaggttcgttggcgcattgacaagggcagatggaactacacctcgaagatcaccgtcaacgcgcgcgacatgggctgggacaacgcgacgcttgatatcgactttgtctcttccagctccacgcctagctccaagaactacacactgagcatcgacatcaccggcggcaagcacggcacgctcagctacaagaacagcaccgtttccgacggcaagacctactccctcgaaaagaacgacaccatgaccttcaaggcagaacctgataagggctacgtggcggcatggaagttcggcaccgagacttatgtcggcagcagctacaccgtcaagatgggctcaaaggacgcgacgctctatgtcagcttcgttgacaagaatgactatcgttggggaaatctgccgttccacgatgtgacgaaccgcgactggtactatgacgacgttctgtacgcctacatcaacggcctcatggacggcatctccatgacgagcttcggcgcggaccagaacaccacgcgcggccaggtcgtcaccattctgtggagactgaccggcgaacccagagcggccagaaacaaccagttcacggacgtttcgtccaacgcgtattacaacaccgcgatttcgtgggcagccgagaacggcatcgtcaagggctatgattccaagaccttccgtccgaacgcgaacgtcacccgtgagcagctggcagcgatcctgtaccgctacgccgagtacatgaacctttccacgagaggcgcttccaacctcaccaagttcgatgactactactccatcggcacgtgggcaagagactccctggcctgggcaaactaccatggcctcatcaacggcgttgacagctaccacatcgacccgaagggcaacaccacccgcgcacagctggcagccatcctgcaccgcttcgccgtggaattcgcctga

SEQ ID NO: 2287 - DNA, 2184 bp, Unknown
  Artificiall/Consensus sequence
atgaagaaacttgttgcacttctgctttgcctcatcatggttctgagcctcgggaccacggctctcgcggcagacggaaaatccaacgacattgtcatcctgcacaccgacgacgtgcactgcggcgtatccgacggcatgggctatgccggcgttgcggcgtacaaggccgagatggagcagacgcacaattatgttgcgctggtcgactgcggcgacgcggtacagggcggcgcgatcggcacgctttcgggcggggcgtatctggtcgatatcatgaacgagaccggctacgactttgccaccttcggcaatcacgagttcgactacaagatcccacagttgaccaagctgaccaagcaggccaagttcaaatacctcgcctgcaacttcaagtacctcggcaagggtacgtccgacatcgcctacaagccgtatgagatcgtcgattacggcggaaccaaggtcgcttacatcggcatcgccacgccggagtccttcgtgaagtccacccccgcctacttccaggacgcaaacggcaactacatctattcgttctgcgaagacgacgacggctcggcgctgtataaggctgtgcagaacactgttgacgaggtcaaaaaggccggtgccaactacgtcatcgctcttgctcacctcggcaacgaaggcacgaccgaccgttggagctccaaggctgtcatcgccaacaccaccggcatcgacgcgatgctcgacggtcatgaccacctgacgctgacgacaaaggtctctaacaaggacggcaaggaagtcatcctcgccgaggctggtcaggaagagggtaagctcggtatgcttggcaagctgaccatcgccgctgacggcacgatcacctccgagctcatctccgccaaggatttcaccaaaaaggatgaaaccgttgcggcgtatgtcgaaaacatccagaactccttctccgacaccgtttccaaggtcgtcgccaagagctccgttacgctcaatgactacgacgaaaacggcaaccgccttgtccgtaattccgagaccgcgctgggcgatctcgcggcggacgcttaccgcgtcatgatggacgccgacattggcatcatgaacggcggcggcctgcgcgctcccattaaagaaggcgacatcacacttaacgacatcctcaccgtcttcccgtggggcaacctcccctgcaagatggaagtgaccggccagaccgttcttgacatgctggaaatgggcgcaatcaagtacccgtccgagtccggcggcttcctgagcgtctccggcctcaagtacaccatcgtctcgagcatcccctcttccattgagctgagcgacaagggcgagttcgtcaaggtcgcaggcgcgcgccgcgtgcagaacgtccaggtgctcaacaagaagaccggcgtctatgagccgatcaaccccaacaagacctacaccctcggcggcatcgactacaccatcacctactgcggcgacggcttcacgatgttcaagaactccaaggttctcaaggccggtgatgcgaccatgaccgacgcgcagacggttctttcctacattgagaccaagctcggcggaaccatcggcgagcagtattccaagcccgctggccgtatttccatcgtgaagtacaccgacgttgtccccggcaagtggtatgagaaggctgtcaactatgtcagcgacaacggcctcatgaacggcgtcggcacaggcttcaatcccgacggcgctctgacgcgcggcatgctcgtcacgatcctctaccgtcaggccggttcccccgctgtcgagacgaaggtctccgccaagttctccgactgcgaggaagacagctggtacgcacctgctgttgtctgggccgctgaaaacggcatcgtcggcggctacgcggacggcacgttcgcgcccaacaaggccatcacccgtcaggaaatggcgaaggtgctctatggctatgacaagaccatcagcaaggccaagaacgaggcggcaaccgagctgacctacaccgaccttacctccatcgcggactgggcgctcgagggcgttcactactgcacggcggccaagtacctttcgggctcgaacaatgcgttcaaccccaacggcacggccacccgcgccatggtcgcacaggtcttcatgaacatggcggcctga

SEQ ID NO: 2288 - DNA, 2394 bp, Unknown
  Artificiall/Consensus sequence
atggcacgcaaaatcattcccctgagacggaaaaagcaggaaccaaagctatcgcgcgccgagcagtcgcagcgtgccaaccggacgattctcagacggacgcttgttctgatggcgctgttcggcgtggtggtattcataccgcttattgtgacgctctacaatctcatgatccgcgaccacaactattatgaggcgcaggccatcgacaaccagacgcgctacacaagcttatctgcctcacgcgggcagatcttcgaccggaacatgaacgtgttcgcctcgtcgaagacggtggagacggtctttattgaccccaatgagatcgcgcaggagatggcaaagcccgaaaacagcaatcttctggaccacatcgcgcgcggcttatcggaaatcttagacgtgagcaccgattttgtctacaagcaggcttcggacaaggcgttccgctacaaggtcatccgtcggaagatcccggaggagattgccgacgaggtgcgcaatttcgtctcagagaacgagatcaagggcgtgtacctcgagaccgacgcgcagcgctattatccctattcgtcgctcgcggcgcaggtgatgggcttcgtgtcgacggataatgtcggctcggagggcctcgaggcgtactacgactcgtatttgcagggcacggccggcaaggtcgtcacgacaaagggcaactacggctcggagatgctctatacatatgaaaaatactacgatgcgtccgatggagacagtctggtcacgacgatcgatcagaccgtgcagcattatttagagaagaacctcgagacggcgatcgagaaatatgatattctgaacggcgcgttcggtatcgttatggacgtgaattccggccagatcctcgcgatggcgaacctcggaagctacgaccccaacaattatcaggagatctacgatcaggagcttgctgagcagctggaggagcagtatcaggacgcgcttttgctcgacaaagactcggaggcttataaagaggcaatgagcgcctacaaccaggccgttgcgaccgagcgcctgcggcagtggcgaaaccgctgcgtctccgacggctatgagccgggctcgacgttcaagctcgtgacgctggcggcggccttggactgcggcgcggtcacggaaaacagcaccttctactgcggcggccacgaaaccttcaatgaccgcgagcaggaggtcagctgctggaaggcggcaggccatggcatgcagacgacgatggaggctttggggcattcgtgcaacatcgcctttggccacatcggcgtcaatatgacgagaaagacgtttgtggaatatttcaaggcgttcggctttctggagaagaccggcgttgatcttccgggcgaggcttcgggccttttctgggatgagaacgacttttccgtcgcgaacctcatttccgcgtctttcggccagaccttccgcgtgacccccatggagcaggtgcgcgcgatcgcggcgatcgtcaacggcggatatcttttaaagccatatgttgtcagccaagtgttagacagcgacggcagcgtcgtgaagaccaacgagcgcacggttctgcggcaggtcatcagcgaggaaacgtcgaagaccatgcgcaagatgatggagtacgtcgtcaccgacggtacggcgggctctgccaagactccgggctaccgcgtgggcggcaagaccggtacgtccgagaaaatcgacgtgtttgatgaaaacggcaatccggtcgaggacaagatcgtctcgtttatcggtgttgcgccgatcgacgatcctaagtacgtcgtgctcgtcgcgctcgatacgccaaattacgtggccggaacgagctacaccccgcataaccagtatatttcgggcggccttatggcggcgccaacggtgcgcgatgtgttcctcgatattctgccgtatctcggcgtggagccggattactcctccgacgacatccggggcgtcaacattacgcttcccgatgtgatcggcatgacgcaggacgaggccgcaaagctgctttccgacaagtccattacctaccgcaccgtcggtcagggcgataccgttaccgaccagcttccgagcccgggcgcggaggttcccggcaattccgagatcatcctctacttcggcaacgccgtcaagacgaccgagcaggtcgaggttcccaacttcgtgggctacggcattgcagacgtggattatctggcgacaaacgccggactttacattcaggccaagggcaccgatcaccgcgacgaatacgtcacggtcgcatatcaggacattgagcccggaacaatggttgacagagggagtacaattacggtagaatttactaccggcggagcctccgactaa

SEQ ID NO: 2289 - DNA, 1500 bp, Unknown
  Artificiall/Consensus sequence
atggagcaaaccgtactgcttcagatgaaagacattacaaagaacttccccggcgtcagggcgctcgataaggtcagcctggaggtcaaggccggaacggttcacgcgttgatgggcgaaaacggcgccggcaagtcgacactgatgaaatgcctgttcggcatttacaacaaggacagcggccatatctatctcgaaggccgggaaatcaatttttccagcagcaaggaggcgctgaataacggcgtcgccatggtgcatcaggagctcaatcaggcgctcaagcgctcggtcatggacaacctctggctgggcagatacccgaaaacagccggtttcgtggtcaacgaaaagaaaatgtaccacgataccgttgaaatcttcaacgagctcggcattgacgtcgatccgcaccggatcatgagcacaatgccggtttcgcagcgtcaaatggtggaaattgcgaaggcggtttcctatcactcgaaaattattgtatttgatgagccgacgtcgtcgctgacggaggaagaggtggagcatctgttccgcatcatcaacatgctccgcgaccgcggtctcggcatcatctacatttctcataaaatggcggagatcaagcgcatctccgatgaaattaccatcatgcgcgacggccagcatatcgcaacgaagcctgctgcagagctggagatgaacgacatcatccgcctgatggtcggccgtgagctgggcaaccagttcccggagaagacgaataagccgggtgagacctatctcgaggtcaagaatctttccggcatgtataaccagctgcacgacgtgtcctttacggcgcggcgcggcgagattctgggtctggctggtctggacggcagcggccggacggagacgctggagacgatcttcggcgtggctacgcgtaaaaccggaacgattttgctgggcggcaaggaatgcaagaacaaaaacccgcgccagtcgatcaagaaccgcttcgcgcttctgaccgaggagcgccgcgcgaccggtatcttctcgatcctgaacatccgggaaaacacggtcatctccagcctcaaaaagcataagcgcttcggctttgtgcttagctcgaagtccatgaaggccgatacccagtggtcgatcgatgcgatgcacacgaagacaccctcgcaggaaaccaagatccgtgcgctctccggcggcaaccagcagaaggtcatcattggccgctggcttctgacggacccggaggttttgctgctcgacgagccgacgcgcggcattgatgttggtgcgaaatatgaaatttatcagctgatcctcgaccttgcgaaccgaggcaagacggttctgatggtttcgtctgaaatgccggagctgctcggcgtgtgcgaccggattctggtcatgtccggcggacagctcgccggtgaggtggacgcgaaaaccgcgacgcaggaagatatcatgcgccttgcggccaagtatgtataa

SEQ ID NO: 2290 - DNA, 2097 bp, Unknown
  Artificiall/Consensus sequence
atgcaaacggtttctgattatttcggaagtctggtgtttgacgacagagtcatgcgcgcaagacttccggccaaggtctacaagtccctcaaaaagacgattgacgaaggggtgagtctggataatcaggtggccaatgctgtagccgaggccatgcgcgactgggcagtcgagcacggcgcgacgcattttacccactggttccagccgctgaccggcattaccgccgagaagcacgatagctttatttccccgtcgcccgacggcggcgtgattatggagttttccggcaaagagctcatccagggcgagccggatgcgtccagcttcccgtccggcggcctgcgcgcaacgtttgaggcacgcggctacaccgcttgggaccccacgtcctacgcgtttttgaagggcaagacgctctgcatcccgacggcgttctgctcgtacggcggcgaggcgctcgataagaaaacgccgctgctgcgctcgatgcaggccatcaacaagcaggcgatgcgcgttctgaagctctttggcaacgaagacgtgaaatgcgtcaagacctccgtcggccccgagcaggaatacttccttgttgaccgcgagatgtttgacaagcgcaaggacctcgtcttctgcggccggacgctctttggcgcgaagcccccgaagggacaggagctcgatgatcactatttcggctccatcaagccgcgggtcgcggaattcatggaggacctcaacgaggagctctggaagcttggcatccttgccaagaccgagcacaacgaagtcgccccggcgcagcatgagctggcccctatttatacaacaaccaacatcgcaaccgatcacaaccagctgacgatggagatcatgcagaaagttgccctccggcatggtctcgtgtgcttgctgcatgaaaagcccttcgcgggcgtcaacggctccggcaagcacaacaactggtcgattgcgaccgacacaggcgtaaaccttctgacgccgggcgaaacgccgtatgaaaacgcgcagtttttgctcttcctgtgcgcggtcattcaggccgtcgacgattatcaggatttgctgcggctcagcgttgcgacggctggcaacgatcaccggctcggcgcaaacgaagcgcccccggcggttgtgtcgattttcctgggagatgagctgaccgcgattttagacgcgatcgaagccgatgcaccctacaatgcggcggagaagacggtcatgaagctcggcgtgcatgtgcttcccaagttcctgcgcgacacgacggaccgcaaccgcacttcgcccttcgccttcacaggcaacaagtttgagttccggatgcttggctcggccaactccattgcctgcacgaacattatgctcaacggcgctgtcgcgcagtcgctcaaaggttttgccgatgcgctagagaaggcagatgactttgaaggcgcgctgcacgatctcatccgcagcacgattcacgcgcacaagcgcatcatcttcaacggcaacggctacgacgacgcatggatcaaggaagcaaccgaacagcgcggccttctgaacttaagaaccacgcccgatgcgatgccgacgctgctggaaaagaaaaacgtcgacatgctgaccggcctcaagattttcacgaaggcggagctcgagtcgcgctacgagatcatgatggaaaactacgtcaagactgtcaccatcgaggcgcagacgatgctggacatgacgcgcaaggagatcctgcccgccgttgccggctacacgaaggagctcaccgagacactggctgccaagcgcgcgatcttaccgtcgctgccggcaaaatacgaaaccggcacgatcacgaagctctcttcgcttctcgaccagatcgacgcggcggcagacgagcttgaaaaaacgacgctccagatcaaagccattgacagcgtcaccgagtccgcgttccagattcgcgacgcgatgctcccgagaatggcggcgctgcgcgtggtgtgcgatgaggcagagcctctgaccgctgaacgcttctggccgttcccgacgtacgacaagcttctgtttggcgtgagataa

SEQ ID NO: 2291 - DNA, 1983 bp, Unknown
  Artificiall/Consensus sequence
atgtccgccaacaagaacgaccccaaggacgccgtaaagatgacctccggtcttgacagccagacgcaggcagacctcgacgcgctgatgcgcaaatacgaccgtgagtccaatacgcgcgtgtgggagggctggcagcgctgggctgtcggcgcgatcatggttattttcagcctgtactgcatcggtatgacgctgttctattccggccttcccgaaacgagacttgccgcgtttctggcgatgatcgtattcatcggcttcctcacctaccctgtcaaaaagggtcacgtgaaggtgaactctatgccgtggtacgacatcatcctcatgctcgtaggcgcatcgtgctttttgtacttcgccttcaacgcccttcccatcatcaagcttgcaaccagaatccagacgcaccatgtgatcatcggcgcgatcggcattctggtcctcatcgagctctgccgccgctgcgtcggcgttccgatcctgtgcgtgctgggcgcgcttctcatctatacattctataaccagctgagctacaaccccagcctctatcaggcgctcaagaacatcgtctataagctcttctacaccacaaacggcgtcattggtacgcccgtgaacgtctgctacacgtacattgtcctcttcatcatcttcggcgcgttcttagagcgtaccggcattgcgaacttcttcattgcccttgcaaaccgtttggccggttggtctgccggcggtcctgcaaaggtcgcggtcatctcgtcggcgctctgcggcatggtctcgggctcttccgtcggcaacaccgtgaccacaggctcggttaccatcccgatgatgaaaaagaccggctatcacccggactttgcgggtgcagtcgaagcggctgcctccacgggcggccagatcatgcctcccatcatgggcgcggcagccttcctgatggctgaatacatggatcttccctacgcaaccgtcgccgtcaaggcgattttacccgcggttctttacttcacgggcattttcatctccgtgcatctggaggccaaaaagctcggcctcaagggtctttccaaggacgaaatgcccaagtggagcttcctgctgcggaaaatctacctgctcgcaccgctggtgcttctcgtctggcttgtctcctcgggcgcaaagaccatgcagttctctgccgccgtgtcaattctggccgccatcatcgtaggctttttgaacaaggacgagcgcctcacgctcaaaaagatctttgaagcgctggaggcgggcgcgaagggcgcaattaccgtcggcgtggcctgcgcaattgcaggcatgatcgcaggctgcatcactgtcacgggccttgcatccatcctcatcaacgccatcgtccagctcgcgggctccgcgacctttattggcctcatcctcacgatggtctgctgcatcgttctcggcatgggcgttcccacgaccgcgaactactgcatcatggcctcgacctgcgcgccgattctgattaaaatgggcttcccgctcgtcgcggcgcacttcttcgtattctacttcggcatcgtcgccgacatcacgccccccgttgcgctggccgcctacgcgggttctgcgattgcaaagggcaaccccatgaagaccggcatcaacgcgacgaagcttgccatcgcggccttcatcgtgccgtatatcttcgcctatagccccgccatgctcttcgtgaacgtcacgagcgtgtgggcggtcatccagattgtcctgtcggcgcttcttggtatctttggcgttgctgcgggtctggagggcttcatgctgcgcaagatgaactggctgttccgcctcatctgcatcggcggtggcctcggcctgatgatccccggcgcgctctccgaccttgtcggcctcgtgctcatcggtggtgtgttcgccatccagtacgtccaaaacaagaaggaagcgctttccaaggactga

SEQ ID NO: 2292 - DNA, 5916 bp, Unknown
  Artificiall/Consensus sequence
ttgtgtgcagcgctgcgggaaaaggcggcgggcatacagtttgcgcagaaaaacggctgctgcaccgattgggtgcggcagcttttttgtttgcggaaggcttcgaaggcaggggcttggtttccgggaagacaggcgaaatacgccgggaacatggaggaaggtatgaagaagagaattgtctcgctggtgctggcgctggttctggtgctcgggctgctgccggggtcggtgatggccgcgtggcccagcttccggggaaacggaagcaacatgggcattacagacgtgcagacgcccgcgcctgactatgcaaagctccaatgggcggctaaaatcggcacgtcggcggagagcatgacgacaagcaccgtctatgccgggcagccggtcgtggagggtgagtttgtctatgcgacggcggggcggacgctttataagatcaaggcgctggacggaagcgtggccgtgcagcaggtgatggacgggaaggaccgttttggcacgatcccgccgacgatcgccggggacatgatctatgtggcgctggacggcggcatggtcgaggcgttcgacaagaatacgctcgtaaggaaatggacgcttggcgggctttccgccggagggcagaacagctgcccggttctggtgtccgaaggccgggtctatacgggattttatgattcggagaccggcacacagaactatgtctgcctgacgacggcgggaaagcgcgtctggagctatgaaaatgcgggcggcttttactgggccggcgcagtcgcggtcggggactatatttttgtcggcacggacgacggcgcggagagcggtgtgaacggaacctcgcgcattttgagcttccgcaaggacgagacgagcaaaaatcccgttccgcaggtgctcgagctgcaagaccttggcgaccagagaagctcgctcgcgtattccgaacagaccgggcggatttattttacgacgaagggcggctatctctgctcggcgaaggtggacggcaaggccggtacgctcacggagctcaggacctgccttctcggcatgggaagtacgagcacgccggtctattataagggctatgtctatatcggaaccggcacgggtccggggccgagcggtgggtttgccattgtgaaggagaacgcgcagacgggtgatctgacgcttcaaagggagctcacgatgcccggcagcacgcagggctcgccccttctgagcacagcgcgggaggcggaggggtatctctatttctatgaatgcgcaaactataagccgggcgggcttatctgcatccgggtgaacgcgaatagcccggagagcacgactgcgtcggacgtctttacgatctttgacgcggcggattatccggagtactgcgcggcaagcccggtctgcggagacgacggcaccatttattacaaaaacgactccggctatctgttcgcggtcgcgaaaacgcaggctccggcggtcaagtttacccggcatccgcagagcgcggcatatgcgcccggaaagacggcacaggcccttacggtgacggcagtggcggcagacaatgcggcgctcagccatcagtgggagaagtcttcagatgaaaaaagctggacggccatcgaaaatgcgacgacgagcagctatgtcccggaaattccggcgaaaatcgagggcgagcaggtaacctattaccgctgcaaggtgacgtctaccctgaacgggaagacggcgtgggatgtgtcgcacacggcggccatcacggtcaaggcgctcagcgcggacacgacgatttcctatattgtgaccgacggcaacgaggaaccgacaggcgcaccgacggcggcttcggtcagtgaaacaacagttgtgctcaactatgcggagttgggggcgaagaaaccgcgcgtctggttccagccgccgcaaggcggcacgctgcgcgtaacgcttggtacgtgcgacgacccggcggcgcgctatgacggttcgggtgattataccgaccgcgtctacttccgaagtggtataacgggcacgaatatcatccgtgtcaccgcgacggcggaagatggcgtgacgcagacgacgtatactttcgttttgacaccggacggaagttatgacggcctgcggagcgtctatgtgacgatcacggatcagggaagcgtcgctgtggcgcagaagaagctttctgtggacgaccggaacggggacggcaaaattacgaacgacgacgtgctccgtgcggtgcatgcgaaatactgcccggacggtgtgagcggctatcaagcggcggatagcgaatacggcgcatatatcacgaggttctggggtaaggataccggcaacaccggctactggaatggcggccggatgtgcatgggacttgacgaggaggtctcggacggcgaccactttgtcgcgatggcgtatgtcaaggcctatccggagacggaaagctacgcgaagttcggggaattttcttacactgcgtccgcaaacgcggcggtttcaatctcgctggaaacagtgaccggctatgacgcctcatataacccggtcttcggcggctgcgagggcgcacagatcacggcctatcgcgccacggacggcgcgacgggagaggcattggaaaagaatctctatacagtcgcagaaacgggaaacggatattataccgtgacgttctcgcaggcgggagagtattatctggttgccgcgaatgcagcggggacgatcgtcccggcggtctgcaccatcagcgtttcggacggacaggcaccgggcgaagaggtcaccgtgacattctcgctgctgggcgatgaagcgcacggcgcaggcgaaacggcgcacacgctcaagggcggcaacttaacgacgtggatcgacaaggccagcgtgacggttccggcgggcgcgacggtgctggatgtgatcgaaacagcgttcgttgcgcaggaggacccgacgtatagctggaagggcgacccggggtatatccgctcggtgacgagatcggtcaagggcggcaccacgacgacgcttgccgagggaagcaacggcacaaactccgggtggatgtacacgttcaatggcgttcataccaacaaggcggtaaacgagcaggtcgttggggacggagacaaaattgtgctccactatacggacgactacacgctcgaagccggcatggtctacacgccggcggacgtgatggagcggatcggcgcgatcggcgaggtgacgaggctgagcggccccgccatcgacgcggcaaggagcgcgtatgacagcttgaccgatgaagaaaagacgcaggtcaagaactatcagacgctgctggacgcggaagaagcgttccggaacctttcttccagcgtcgactggaaaacagcctaccgcgagacgggaacaaagctgctcgacttggtgctgcagggcaagtggacgacgggctcggtcggcggagagtggatgatgctcggccttgccagaagcgagcggctctatggcggcgacgtggaggactatatcaaggcgctcgagtcgtttgtcaaaggcaatatcaacgccagcggccaaatccggcgaaacggcgacgcgagatccacagagaacgcgcgtgtggcgctggcagcgtcggcgctcggctatgacgcaaggagctttgcgggctatgatctgctcgcggcgatggcggataccgcgtgggtcacgaaacagggcaacaacgcgtctgcgtttgcgcttctggcgatgaatgcgaagacggcgtatcttgcgggcgatgaagcgctgcagcgcgcggcggaaacgctggtcaagagccttgttgacaagcagaatccggacggcggctgggcaaatacgacgggaaacagcgaccttgacaccacggcgatggccctcacggcgctggcagcctatcggcaggacaaccgggacgctgcggacgcgatcacgctgggcctttcctatctggcgggccagcagcttccgagcggcgcgatcggaaccacggcggagacgtcggcgcaggcattggtcgccctgagcacgctggggatcgacgcggcgacggatgcgcggttcagcaaggacggaaagaccgtacttgacgggctgctgcaatattatttggacggcggcgggttctatcacgcggcgagcgcagcgggctacaaccagatggcaagcgagcaggcgtattatgcgctggcagcttacgcgaggctcacaggcggcaatgcgcacgggctttatgacatggacgacgcaaagaagctcgacgacgcggcgctggaggacgttctgcgcgagatcgaagcgctgggcgagatcaccgacgcgagccgggagacctatgtcaagctcgagaccatccggcagaaaatccgctatctgaaggacgaagacaagaagaccgcgcaggacgcgcttgaagaaaagcagagcgcgttcgatgagattctcgcggagaagaagcagacggcacggacggtttcactttccaaggtctatgacgcggtcattgatgcggcaaagaaggaggacccctcgcttctgaccgacgcagcgctcgaagaggtgcgcaaggtgatggcgcaggcggagaaggatatccgggacgcggcgcacaccggggagatcggagacattctcgccaaagcgaagaccgatatggaaaacgcgctgcattcgatgaaggtctcgttccggctgatcggagactttttgcacgaggaccagggagacgagcacaaggactatgtgacgtggatcgaaacgaagacgtatacgctcagcgccggagcgacggtgaaggatttgctggaaaaggcactggatgagacagggcttcaggagaccggcgcggacgacggctatgtgagcgctattctggcgcccgaggcactgggcggctactggctgagcgagatggacaacggtgcgaattccggctggatgtacaccgtgaacggcgagcatcccgatcaggcgctgaatgacttcacgctcgaggcgggcgacaaggtcatctggcactatgtcgacgactatacgaccgaggccgatgcggagacgtggctcaaggcggcggatatttcgccggaggaatacgcgaagcagaagctggcgcggatcgtgcaggtgatcggcggcggcacggtggagccgactcttggcttttcgcagctcggcgcggatgtgacgtttaccttcgagccggatacgaaccagcagctgctggaggtgacagtggacggcaagtccatcgggacgccggagagctatacgtacaagaacctgacgttaaacagccggatcgtggcgacgtttacgggcgcgatgctcttcttggatgtgcggcgcgaggactggttctacagcgatgtgcgctatgtggtcgagcatgggctgttccacggaacgacgcaggagcgcttctccccgaacgcgccgatgacgcgcgggatgctggtgacggttctgtaccggctggcgggaagtccgaaggccgcagagaatagcggctttgccgatgtggcggcgggcaagtattacgcagatgcggtctcgtgggcggcagaaaacggcattgtgagcggtgtgagcgacggatgctttgcacccgacagtcgggtgacgcgcgagcagctggcggcgattttgtaccggtatgcaagggacaagcgctatgatacaggcaagacggccgatctgacgggctttgccgactacggccaaatctctggctacgccgccgaggcgctcagttgggcgaacgcggaagggctcgtgaatggcagaagcgaaacggcgctctctccgcagggacaggccacgcgcgcagaggttgcggcgattttgcaccggtttgcggaaaatgttgcaaaataa

SEQ ID NO: 2293 - DNA, 2508 bp, Unknown
  Artificiall/Consensus sequence
atgcgggcgcgttttgcgataaaatggaggaaaaacatgcgagcagataaaaatacacagccctccggctctgcggcacggcggattttgaaaggcttcggaaaggtattcggcacgatggtactggtgctgtttctgacgacgctgatttttgcgtgcctgtttgccctgtacgtcaaaaacaatctctccgcacaggtcgactcgatcgacggctttacgcttgaccagacctccgtcatttattatgaagacccgaagaccggacaggacgtcgttctgcgcaagctctacggcggcgcgaaccgcacgtgggtcaagtacgaggatatccccaagaacctcattcatgcctgcatcgccatcgaggacaagcgatttgaagaccatcagggcgtcgactgggtgacgacgcttaaggcctgcgtcaaaatgttcctcggaagaggagaagcgggcggttcgacgatcacgcagcagctcgtcaaaaatatcacgggccgcgacgaggtcacggtgcgccggaagcttgttgaaattttcagcgctttggaacttgagaagaagtacacgaaaaagcagatcatggagctctatctcaacgtcatcgcgctcggcgaaaactgcgagggcgtggagtctgcgtcgcaggtttatttcggcaagagcgtgagcgagctcgatcttgccgagtgcgccgcgctcatcggcattacgaacaacccctcgatctacgacccgtatatcaacgccgacaagaacaaggagcggcaggtcatcattctcgaccagatgctcgagcagaagtatatcacgcaggagcagcacgacacggccgtcgcggaggagctggtgctccataatgccagcggcgaagcgtccggcgatgaggactactattcctactttgaagatcaggtcatcaacgacgtcgtgcgggacctcagcgaaaagaccggctacgatcagacgatcgtccgcaagatgctcatgacgggcggctataagatttattcaacgctcaaccccgatgttcaggcggcagtggaggcggtctatcagaacctcgacaacatccccaagaccgcaagctctcagcagctgcaatctggcattgttatcattgataataagacgggagacgttgtggccgtggccggcggcgtgggcgaaaagcagggaagcctgatcctgaaccgcgcgacgcagagctatctgtccccgggctcgaccatcaagcccgtttccgtctacgcgcccgcgctggagctcgggctcatcacgcccgcaacggtcatggacgatacgccgtattcctttaccgacgcgcggcactggccgaaaaactccgattcgatctacaggggcctcatgaacatcaacgaggctgtgggtctttccatcaacacgatccccgtcaagctcgtcgcgcagatgaccccggaatacagcttcgagttcgcgaaggaaaaaatgggactcagcacgcttgtatcgtcctatgtaaacgcggcgggagacacgttctcggatgtggacctggcgccgctcgcgatgggcggattgacccggggcgtgaccgttaaggcgatggcgcaggcttacgcgacgtttgcgaacgaaggcgtgtaccgtgaggcgcggacgtatacgaaggttgtagactccgacggtaaggtcgtgctcgataatacgcagcagtcgcacgttgcgatgaaggacatgacggcttggtatattacctatatgctggagaacaccgtcgaatccggcaccggcacggcggcacaaatcgcaaacatgaccgtcgcgggcaagaccggcactacgacaagtgactttgaccgctggttcgcgggctatacgccctattataccggcgtcgtctggtgcggctacgacgaccccgaggaggtcgtgctgacggattcgtcgacgaatcccgccatcgtcctgtggcagaaggtcatggagcaggtgcacgacggccttcccaacaaggaattcaacaagcccacaaacgtggtcgagtgcacggtctgccgcgacagcggcctgctcatgacagacgcctgccgcgaagacccgagaggaagccgcgccgtgactgtggagctcagtctctacgatgtgccgacgcagaactgtgatgtccataaggaagtggagatctgcggcgcgtcggggcacgtggtcaatgaatactgcaagcaggtcgagggcaatacgacgaaaaccgtgggacttctggatgtttcgcgagccttcccggtgcgcgggatcacggtgcaggaccaggcctacgccgtgccgaacgactctctgcccgcgggctattacccggcattgagcccggatgtggacgcgatcaatgtcgagtgctacatccacacaagagatgatctgcccgagcccgaagcgccggaagacgaggaagaggaagacagtgcaagccgcatttccgccgctgtgcgcgatatcctcacgggcggcagccagaacgattaa

SEQ ID NO: 2294 - DNA, 1389 bp, Unknown
  Artificiall/Consensus sequence
atgaaaagattcttcgccttgctgctggcgctgctcatggtcctgtctttgacggcctgcgtttccagcaacaatgccgcccagactacggccactgaaaccgcagctctgagccccgaggctgcggccgaacaggctgcggcggaaaccaaggacaccacgagtctgtccgatatcatccgcgtcccgttcggctatctgctcgactggctgtatgtcttctcgagcaactacggcgtggcgctgattttgttctcgctgatcgtcaagctcgtgctgcttccgatgagcatcaagagcaaaaagagcatgctcaaaatgtcccgtcttgccccgctggcccgttccatcgaggcgaaatacggcgacgaccgccagaaagcccagatggccgtccagcagatgtataaggaagagggcgtctcgatgggaggcggctgtttgtggtcgttcatcccgctgctgattctcttcccgctctactacgtcatccgtgagccgatcacgtatatgctgcacaactcgcgctcggtgtcggctgccatcgttgcgttcattcaggccagcggcgtcgatcttggcaagaacacgtactatgcccagctggccgcagccggtcatcttggcgagttcgcagaggccatcaagtccgtcgccgttatggcaagcgcgaaattgcaggatatcgatttctcgttcctcggtgtggacctcgcagccatcccgtcgttccgcttctggcagtgcgaaggctggagcgagatcggtctgttcctgatcccggtcttttccggtgtgttccagatgttttcgatgttcatcagccagaagatgaacaaccaggtcgcgaccaacgcagacggtgaggtcgatcagaatgccgcgcagatggcaaaccagaccaacgcgtcgatgatgatcatgatgccgctgatgtcgctttggatcggcttctcgatgccggccgctatctcgatctactggatcgcgcaggccgtgttcggaaccgcccaggacgtgatcctcaccaaacactaccgcaaagtctatgacgcagaagacgctgtccgccaggaaaaggctgcgcttcgccgcgccgaagaggcggaaaaggagcgtcagcgccagcttcgccgtgagcagaaccccgacggcattctcgcagataacgtgagcaagaaaaaggtccgccagcaggagaaggaagcggcagagaaggcggccagagagtacgccgccaagaagaatccggaactggaacaggacgaaaagaagccgctgtccggcattgccgagcgtccctattgccgcggccgcgcgtatcaggcggaccactatggcaagcgcggcgcgcagaaggaagcctcttccggagagaacgaggagtaa

SEQ ID NO: 2295 - DNA, 1689 bp, Unknown
  Artificiall/Consensus sequence
atgaaaaagcgaagcctcagcatgaaccagatcatgattttgtctctgacggcgatcgtggtcgggattctcgggtgcgccatcgcgtttttcctgcaaacgtaccagcgctctctcatccgtaacgcgcagaccgacggccggcgcacgatctcgcaggtgaccagtaccgtagacggctatctcagcgatatgaacaacgtcatggagctgctggcagacgagctcgtcacgccgtcggacgaccgcgagcacttttttgaaacgttccttaaaatccgctccgacgtggtcgctgtgacgatctatgacgaggcggggtacctcatgaactgctacagcttagaccacgaggtgcggccggtcgtgcgggaaaatctgtcctttgaccggacgatgctggatgtatacgcagacggctatgtctccgcgccgcacgtgatgtccctttttgaggggtactatccatgggtcgtaacgatcatccgcccggtggacgcgggcaagtgggaaaaatgggtggcggtcgatatcagctgcacgaacatttcctcctatattaacggcatcggcatcggccagcggggctactgctttctcgaagacacgaacggaaacatcgtctaccacccccagcagcagctgatctattccgacttaaagcaggaaaataccgcgctgatttcgaacctcgacgacggcagccacgtgatcggcacgatgatctacaccgtgcagacgcttgcaagcggcagctggcgcgtggtgggcgtgagctttgtgcaggagatcattacggataacctgcgcgagattgcgcggcttctggcgctggcggccattgcgattgtggcggcgacgctcgcggtgagctttctgttttcaagagttctttcccggccgattcacgaccttatttccgcgatggcgcagtttgagaagaacgcggacaattttgtctatgagccagtctccggcgtgcgcgaggtgcagaatctgtcttcctcgtttgcgcacatggtgcggaaaatccagcagctgatggcgaccgtgcgcgccgaagaggtgaacctccgcaaaacggagctcagagcattgcaggcgcagatcaacccgcattttctttacaatacgctcgactccatttcgtggatgtgcgagcgggggaagaaccaggaagcggtcgtgatggtaaacgcgctggcgcagctgttccgcatcagcatcagcaagggccatgagctcatccccatccgcaacgaggtgcagcacgcgaagagctacctgcaaattcagtccgtgcgctacaaggatcagttctcctaccgcttcgaggtcgacgagagctgcctcgattatctctgcaacaagattaccctccagccgatcattgaaaacgcaatctaccacggcatcaacggccttgttgacgagggtgagatcgtcatccgcatcgagtcgcagggggacgatattctggcgaccgtcgaggataacggcgttggcatggagaaagagcagattgacgcgattttccgccgcagcgactccaaatccggcatcggcatcaaaaacgtcaacgaccggctcaaaatctggttcggcgaggcctacggcatcaccatcgagagtgtccccgacgagggaacgcgcgtcatcgtgcgcatgccgaagaagcagaaggagtga

SEQ ID NO: 2296 - DNA, 2070 bp, Unknown
  Artificiall/Consensus sequence
atgggctatactgccaatgacattcgcaacatctgcctgctgggtcacggcggcgacggcaagtccgcgctgtgcgagagcatgctctttaccaccaaggccatcacgcgtcttggcaagcgtgccgacggcacgacggtttctgacttcgacgacgaagagaagaagcgccagtattccatctctacgtcggtaattccggtggaatataataagtgcaaaattaacgtcctcgacaaccccggctacttcgactttgccggtcagatcgtgcagtccctgcgcgtttccgacgcgggcatcatctgcctgaccgccaagagcggcatcggcgtcggcaccgaaaagggctggaagtacctcgcaaaggccggccttcccgccatgttctacatctccaagctcgacgaagagcatgcaaacttcttcaatgtctttgacagcctgcgcgaaatgttcggcgcgtccgtcattccgttcaccttcccgatccttaagggcgagcaggccgtgggtctggtcgatctgatcgagaagaaggcttatgacgcaaacggcaaggaaatccccctgcccgccgaggccgaagaaaagatcgaagagtacatggcagagctcaatgagcaggtcgccgagaccgacgaagcgctcatggagaagttcttcatggaagagcccttcaccgaagaagagctcctgaccggcatcaaggccggtatccgtgaccggagcgtcacccccgttttctgcggctgcgcatacacgggcctcggcacaaccaaccttctgtcgaacctcgtgaagttcgcgcccaacccccttgagggcaaggcgatggcgcaggtcgacgaagagggcagcaccaaggaattcaagctcgacccgaagggcagcccgatggtcttcgtgttcaacacgctggccgaccagtacggcaagaactcctacttcaaggtcatctccggcgacgtcgaggacaccatgtccttcgtcaacgcgcgcacgggcgacgcggagaagctcggcaacatgttcttcccgaagggcaaggacaacaccaagacctccaagatctgctgcggcgatatcggtgtcttcacgaagctcgcctccgtcaagaccggcgacaccctgggcttagcgggcaagaccgttaccatcgctcccatgaagtacgacgagcccatgtacaagatggcgatctacgccaaggtcaagggcaccgaagataagatcgcggccggtcttgtgaagctgaatgaagaagacgcttccttcacctatggcaacgatcccgaaaccaaggaactcatcatcgcgggcgcgggcgacatgcagctgtccgtcctgatggccaagctccagagcaagtacaaggtcgaggctgtgctcaagcccgccaagatcgcgtaccgcgagaccatcaagaagaaggtcgagatccacggccgtcacaagaagcagtccggtggccacggccagttcggcgacgtctacatccgctttgagccgcagtccgaatccgaagagatgatcttcgcggacgagaccgtcggcggctgcgtgccgaagaactttatcccgtcggttgaaaagggcctgcgcaactgtgtcggcaagggtgttctggcaggctacccggtcgtcttcctgaaggcgacgctgtacttcggctcctatcaccccgtcgactcctccgatatggcgttccagaccgctgccggtatcgcctataaggaaggcctgcccaccgccggcccgacccttctcgagccgatcggcgaactgaaggtcctcattcccgacgccaacatgggcgacgtcatcggcgacctcaacaagcgccgcggccgcgtcatgggcatgaaccccgatcccgagaaccccggctatcagaccgtcgaagcggaagttccgatgggcgaaatgagctcctacaccatcgacctgcgcgccatgagccagggccgcggcagctacacgctgaagttcatccgttacgaggaggttccgcagatgaaccaggccaagatcatcgaggacgccaagaaggacgaagaagaaggctaa

SEQ ID NO: 2297 - DNA, 1701 bp, Unknown
  Artificiall/Consensus sequence
atgcagctttcttttggcgcatcccacaagaaaaagtccgtccgtccggtagaaattttgtttggtttcctgtataataaaaataactatccgccgcgccccggaaacgtttccgcgtgcgcagaccggaacttgcctccgcagtcttttgcggcgaacaaaggagtgaagaatttggccgaatcggaatatgtcattgagatgctgaatatcacaaaggaattccccggcatccgcgccaatgacaacattaccctccagctgaaaaagggggaaattcacgcgctgctcggcgaaaacggcgccggcaaatcgaccctgatgagcgtgctctttggcctgtatcagcccgagagcggcgtcatcaaaaagaacggacaggtcgtcaggatcagcgaccccaacgacgcgaacgatcttaacatcggcatggtgcaccagcacttcaagctggtcgagtgcttctcggtgctcgacaatatcatcctcggcgtggagcccaataaggcgggctttttgcagaagaagcaggcgcgggagaaggttctcgccctgtcgcagcagtacggcctgcgcgtcgacccggacgcaaaggtagaggatatctccgtcggtatgcagcagagaaccgaaattctcaagatgctctaccgggacaacgagattctgatcttcgacgagccgacggcagttctgaccccgcaggaaatcgacgagctcatgcagatcatgaaaaatctcgcggcggaaggaaagtccatccttttcatctcccacaagctcgcagaaattatggccgtcgccgaccggtgcacggtactgcgcaagggaaaatgcatcggcaccgtcaacacgcgcgagacgaccatggaggagctctcttccatgatggtcggaaggcaagtcaacttcaaggtggacaagcaggataaagcgcccggcgaggtcgtgctggaggtcaagaatctcacggttccctcgaagctccacaagaataacgccgtcaagaacgtgaaccttcaggtgcgccggggcgagattgtctgtcttgccggtatcgagggcaacggccagacggagtttgtctacgcgctgacgggccttgagaagcagtcggcaggcgagatcacgctctgcggcaaggacatttcccacgcgtccatccgccagcgctcgaaggacggcatgagccacatccccgaagaccggcacaagcacggcttagtcctcgattttacgctcgagcagaacatggtcctccagcgctactggcagccggagttccagaaaaacggctttatcaacttccccgccgtccgggcgtattccgaccgcctcatcgagcagtacgacgtgcgctcgggccagggttccagtacggtggtgcgcagcatgtccggcggcaaccagcagaaggcgatcgtcgcgcgcgagatcgataagaacccggaacttcttgtggccgtgcagccaacaagaggcctcgacgtgggcgcgatcgagtacatccacaagcagctcgtctccgagcgcgacgctggcaagggcgttctgctcgtgtcgctggagctcgacgaggtcatgaacgtctccgaccgcattctcgtcatgtacgagggcgaaatcgtcggcgagtttgacccgaagaatgtgaccgtggaagagctcggcctgtatatggccggcgcaaagcggatgtaa

SEQ ID NO: 2298 - DNA, 1326 bp, Unknown
  Artificiall/Consensus sequence
aacatgaatgtaaagagcgtagaaaaagaaaacggcaaggccaaggttgtcgtcgagatcgacaaggccgaatttgagcaggcgctgaacaaggcgtacgccaagtgcagaaaagacatcatgctgcccggcttccgcaagggcaaggctccgcggaaaatggttgagagcatgtatggcgcgaccgttttctatgaggacgccgtgaacgaaattttcccggacatctacacgaaggccatcgttgagcaggagctcaaggccgtcggttccccgtccgtttccaacatggacacccccgacgagggcggcgttgtcctgaccatcgagaccgagctctaccccgaggtcaccctcggccagtacaagggccttgaggtgcccaagcacgaggtaaaggtcgaagagagcgaagttgacgcggaagtaaatcgtatggcagagcgcaacgcgcgcatcgagaccgtcgaccgcgcagcagccaatggcgacaccgtcgtcatcgacttcgagggctttgtggacgatcagcccttccagggcggcaaggcggaggactactccctcacgctcggctccggctcgttcatccccggctttgaagatgcgctggtcggcgcagtcgccggtgaggagcgcgatgtgaacgtcacgttccccgaagactacagcgccaaggagcttgcaggcaagcccgccgtcttcaagtgcaaggtgcacgaggtcaaggagtccatcaagcccgagctcgacgacgagttcgcaaaggacgtctccgagttcgatacgctggacgcgctgaaagatgacatccgcacccgcttcacgaagtcccgtacggagcagaacgagcgcgcgtttgagtctgccgccgtgcagatggcagcagccaacatgacctgcaacatccccgcctgcatgatcgacgagcaggttgaccatcagatcgagcagtttgcctatcagctgcagtctcagggtatgaagatggaggactacgtcaagatggtcggcggcgacctttcgagcctgcgcgcttccatgcgcccgatggccgagcagaccgtccgctccgatatcctcctgagcgaaatcgcccacgccgagaacctggaagtgaccgacgaagaggtcgaagaagagctgaagaagctcgccgagcagtatcagatggagcttgacaaggtcaaggccgctgtcgataccgccgccgtgaagtctgacctcatgggccgcaaggctgccaagctcatcaccgacagcgccgtcgccgtcgctcccaccgaggagaagaaggaagacgacgcgacctccgagaaggagtaa

SEQ ID NO: 2299 - DNA, 1266 bp, Unknown
  Artificiall/Consensus sequence
atggcaagagattccatccgctgctcgttctgcggcaagcggcaggaacaggtcaaccggattattgccggcccgaatgtttacatctgcaatgagtgcatcgatttgtgctcgagcatcctgcgagacgaaatgaaaaacggggaaacacaggacttggagcttcccgataccctcccgaccccgcaggaaatcaaaacgtacatggaccgctatatcatcggacaggacgaggcgaaggtcgcgctgtccgtggcggtttacaatcattataagcgcatctacttttcgcaggagacggacgtggagctccagaagagcaacattctgatgatcggccccacgggctccggcaaaacgctctttgcgcagacgctcgccaaaattttgaatgtgccgtttgccatcgccgacgcgacgacgctgaccgaggccggctatgtgggcgaggatgtggaaaatattctgctgcggcttttgcaggcggcagactttgatgtggagcttgccgaacgcggcatcatctacatcgacgaaatggataaaatcgcgagaaagtcggaaaatacgtccatcacgcgcgacgtatccggcgagggcgtgcagcaggcgttacttaaaatcctcgagggcacgatcgcaaacgttcccccgcagggcgggcgcaagcatccgcagcaggagttcatccagatcgacacgacgaacatcctgttcatctgcggcggcgcgttcgacgggctcgataagatcatcgagcaccgcacggacaagtcctcgctcggcttcggaagtgaaatccagagcaagaataagcgcgacgtcggcaagctcttcgagctcgtgcagccgcacgatcttttaaagttcggcatcatccccgagctcgtcggaagacttccggtcattacgtccttgcagagtcttaaaaaggaagaccttgtgaagattctgaccgagcccaagaacgcgctttgcaagcagtaccataagcttctggagtatgacggcgtgacgctcagcttcgagcagggcgcgctggaggccatcgcggaaaaggcgattgaacgccagatcggcgcgcgcggccttcgcgcgatcatggagtctgtcatgacggacatcatgtacaaaattccgtccgaccccgcgattcagagcgtgctcatcaccgaggagtgtgtccgcaacggcaccgagccgcaggtgacgcgcgacgaagcgcatccgcgccagccgatcaaaaacgccggtatcacgttataa

SEQ ID NO: 2300 - DNA, 2091 bp, Unknown
  Artificiall/Consensus sequence
atggtcgtgctcattggcgtgatcgtcgccatcatgtgcgtgtttctgctgcgcatgtatacgctcgcggcggtaagcccggatgagcgcgctgtggcggacgcggactccatgacctatcagacgacggtggaaggcgcgcgcggctgcattctggaccggaacggcaacgtgctggtctcgaaccgcgcaacgtataacatcgtcatcatcaactacgtgctggccaacaccggcgcggcgaatgaaaacattctgaagcttctgcaaatgtgcgagcagctcggcatcgagtgccagagccacttccccgtgacaaatacccggccgtatgaatacgacatgcagagcctcagtacgacgtggcagacctatttccggcagttcctcaacaaccgggactatgacctcgacatttccgcgtcgactctgatgcggaacctgcgcgaggcgtataaaattccgaacgactggtcgcaggaggatgtgtacaaggtcatctctgtacgctatgagctcgagcttcgaagcgttgcgacgaatcttgaaaactacatgctcgcagaagacgtggacgcggagtctctggctgcggtcgcggagctcggcatcccgggcgtcatcgtccagtccggcacggtgcgcgagtataagacggcctacgccgcgcatttgcttggcacgctcggcgcgatggatgctgacgaatgggaggtctatcgggaaaacgacgattacaacatgaacgcgatgatcggcaagagcggcattgaaaaggcgttcgaggagtacctgcacggcgtgtccggcaccaagattacaacggtgtccacgaccggcgatgtgttaagcgaatactatacaaaaatgccagagccgggcaacaatgtcgaaaccacgatcgatatctccctgcaggccaccgctgagcaggcgctcgagaaggtcattctcgatctgcgcgaaaacggcgtcggcaaaaacaaggagggcaaggacgcagagggcggcgcggtcgtggtccagcaggtgaaaaccggcgaggtactcgcctgcgcgagctatccgacttttgacctcagcacctaccgcgagaatttcaaggagctgagcgaggacgagtattctcccttatataacagagcccttctcgcagcctatccgcccggatcgatctacaagatggtcacggcgattgccgccattgactacggccactacagcccctatcatatcatcaccgatcagggactttacacgtattacgactcgttccagcccaagtgctacgtctggtcgcgcgcgaccggcgcgacgcacggccccatcgacatgcggcaggcgattgcgcattcgtgcaactactatttctacgaagttggccgcgtgacgtatgatacggcgcagaaggaggtcggctacaaccccttcgacgtgatcgcgaaggcgctcggactcggcgagcccacaggggtggagctcgatgaggaaaccggcatgcgcgccaacgccgagacgaaaaaggaaatgtacgtaaacgaggattccggctggtacggcgcggacgttctgcaggccgtcatcggccagagcctgaaccgctttacgccgatgcagatgtgctcgtacgtgcaggccttggcaaatcagggcacgcgctattccgcgacgttcctctcccgcgtcatctcgtgggactatcaggacctgattctggagcacgagccggagatcgcgagccagctcgagatgtccgacgacgcgaagctttgcatctccgaaggtatgtatatgacgacgcaggaaggtactgcagaggaatatttcaaatattaccccgtgaaggtcgcctgtaagaccggcaccgcgcagtggcagggcacgacgtcctccggcgcgttcggcggttccgaccatgcctcgttcgtgctctacgccccggcggacgatcccgagatcgccatcgcggtatacgtggaaaagggctcgaagggcggcaatctgtcgaacgtctgtatcccgattctcgacgcatatttctcgtccgccacgcactatgagacggttatgaccgaaaacacggcggactga

SEQ ID NO: 2301 - DNA, 2892 bp, Unknown
  Artificiall/Consensus sequence
atgaagaacttcaaaaaggttcttgcgctggttctggttctggcatccctgctgggtctggcaaccatggccggcgcggcgactgagtacaaggacgccgacaagatcaacgcggattacaccgaagcgatcaaggtccttgatctcatcgaaacaatgcagggctatcccgatgggaacttcaagcccactgcaaccatcactcgtgaagaggctgctaaggtcatcgccatctttgacaacaaggatgcagacatcagcacctactacacctccatcaacccctttaccgatgaaaagggtcgttggggcgagtcctatgttggctacggctatcgcgcaggcatcatcgccggcatgaacgccaccacctatgctcccacctccaacgtcaccggcacccagttcctgaagatggctctggtcaccctgggctacgatcaggagaaggaaggctttgttggcacttcctgggcagtcaacgttctggcgcttgccaagaagatcggcctgatcgacaatctggctgacggctggaagcccgagcatgacctgacccgtgaagaggctgctcagatccttctgaacgctctgaatgctgagactgttgagtacgcacaggaagcaaagtccgctgacttcaagcccactactaacgctgatggtgcttgggtcttcaagggcaagctgtacctcaccgttgctggcgctgtcaagactggcaacaagctgtacaaagacttcgacctcaagaaggaagactccaccgacgctttctatcgtccctacaccaagtggaccaaggataatgtctctgttgagatcatgaaggccccgaaggtcaccttcaccaagaagttctccgcttgcgaactgcttgtcgctctgggcgtcaaggagtccgacaccaagaccaagatcttcatcgataaagtctactgcgatggcgacgacaccgttgatttcgacgactacgatatctacgatgacgcttacaagaacgctgatgacgaagcttactggaagcacggcaacagcaactgcccggatgctaccggtgcaaagcacggcgcacagggcactctgacccaggtcttctacaacggcaaggacgctgatggcaacaagcactacaccatcacctccatcgagacttggctcggcaaggtcaccaaggtcaccaataagaccactgctcacgacaaccacgtcaagagcgacggcgctgtcaagctgaacgcttacttcaacaacctccagaccctcgaagagaacaactacgactactgcggcacgatggacgaagccggccacaccggtcactgcgcagccctcgttgatggctatgagcagaacgaagatggcacgactccgctgaccttcgacgatcccaccggtctgaagaaggacgactatgtcctgttcacctactccttccgtacgctcgatgatgacggcgacgagacggacgactataagtgcgtccagactgtcgatgtcactgaaggtaagaacggccgtctctccggctacaagttcggcacctccgctggctccgatccttccgagacccgcattgacagcgaatacgtcaaggattcccagcacttccacatgggctatgatctgtccaagaccaaccagtacggcacctacaccttcttctatgacgcttacggcaacgtgatcggcatgaaggacgctgctgactcctccaactgggctgtcatcgaccgcgcttgggtcaccttcgagaacaagggcactgctgtcatgaacgctgacgtcgttagcgtcgatgatgcgaagaccaccaccagcactgtcaagaagttcacggatatcaccgattacattgaggctattgaggaatccatcaacgactcctccgcgaagaacttcgcttatgatctggctgtgtacctgaaggacctcaccaacggtgaaggctacaaggacttcgacccgatttacgatcacctgttcaaggtttccaccgacaaggatggcgtcttctccgtgaaggttgctaagaattccgatggtgagtacgttgtcaacggatacggcgatctggaaagcactgatgacaccatcaagactgtcaacggcaagccgtatctggagatcaaggaaggcgacgcggatgctgacaagagcatttcgctgacctccaacaccaagttcctcgtccacaacatggacggcacttactctgcatacaccggctacaagaacgttccgtccctgattgcccactatgctgaggttgtcttcgactccgactatgctgacaagttcgttgctgaggttgtctatctgaccaaggatgtctacacgacagacagcaaggttgtcgcttatgttggcaacggcgctgatcgtagcaacatcgaagttgttgaggacggcgacacgtactacaacctgactgcttatgtcaacggcgaagagaccaacgtctatgtcgacgaggccgatatgaaggcatacttcgacaagaaggccgattccttcgtggctggcttctatgagctgcagtataccgagatcgacggcgtcaagaccgcgaaggtcaccaagaactacaccgcttctaccgacgatgatgacaactacctggtcgagccggttgaggctgagtacttcaacggcactgtcatcaagatcgatggcaagacctacgctctgactgatgattgcggcctgttcgcgatcaacggcaagaaggtcgaaaagagctccgcttccgagatcgaagacctgtacgatgatttcgacagcttcgacgataccaatgacgacaacgagaacgctcacaaggtctacgttgctctcaacgataaggacgaggctaccgcgatctacatcaagctggcagtcaacgactaa

SEQ ID NO: 2302 - DNA, 1224 bp, Unknown
  Artificiall/Consensus sequence
atggaggatttttccgagatgaaaaagatcattgctttgcttcttgcgctgaccatggtatttgctctggcggcatgcgccaagcagaccaccgaaaccccggctacggagaccacgacgactccggagaccaccacgaccgaagaaaacaccaccactgaagagaccccggctgctgagacgaccgaggctgccgacctgaaggttggcgtgttctactacacgttcgctgatacctacatctccagcgtccgtaccgcactcgacgcgcagctcgattctctgggcgttgcctatcagaacttcgacggcaacaacaaccagaccacccagaacgagcagatccagaccgctctgaccgacggctacaacctgctgatcgtcaacatggtcacctccggttctcccgacgttgccaacgagatcatctccatggcaaatggcacccccgttatcttcttcaaccgcgccatcgaggctgacggcaacgagggcaccgtcctcaacgcgaacgctaccatcagcttcatcggcaccgacgctcccgaagcaggccacctgcagggcaagatggtcggcgaatatctgctggccaactgggacaccgttgatctcaacggcgacggcaagatcagctacgcgatgttcaagggtgacgaggccaacgttgaggccatctaccgcacccagttcggtgttgaggatgccaacgcggttctgaccgaggctggcaagcccgagcttgagtacttcgacgcttccaacacctccaagtatcaggtcgacctcggcggcgcatggtccgcacaggctgctctggactacatgaacaccaacctttcgcagtacaatgaggccaacggcaacatgatcgagctcattatctgcaacaacgacaacatggcagaaggcgccatctccgctctggagaccgctggctacaacaccggcgccgaaggctccaagaccatccccgtctttggtgttgacgcgaccgacgctgccaaggaactcatcgctgccggcaagatgaccggtaccgtcaagcaggacgccgagggcatggctgttgcgattgcttccgtcgtcaaggctaccggcgaaggtacgtccatggctgacgctgtctccgctacctctgcgaccaaccccgacatgtacacgatcgctgacggcattgccaacaagctgttcgttgcatacgctgcttacaccgcagaataa

SEQ ID NO: 2303 - DNA, 2634 bp, Unknown
  Artificiall/Consensus sequence
atgtctcataaatacgtttacctgttctcggaaggcaacggccatatgcgcgagctgctcggcggcaagggcgcgaacctcgccgaaatgaccaacctcggcatgccggttccgcagggcttcaccatcacgaccgaagcctgcacgcagtactacaaggacgaccgccagatcaacagcgagatcgaagcggaaatcatgcagtatgttgaaaagctcgaagagatgaccggcaaaaagttcggcgatctctataacccgctgctcgtctctgtccgttccggcgcgcgtgcttccatgcccggcatgatggatacgatcctgaacctcggtctcaacgacgaggtcgtcgtcgccttcgcaaagaagacgaagaatccgcgtttcgcttacgactcctaccgccgcttcatccagatgtactccgacgtcgtcatggaagtcggcaagaagtactttgagcagctcatcgacgagatgaagcaggcccgcggtgtcacgctcgacaccgaactgacggctgacgatctcaaggagctggcagaaaagttcaaggctgagtacagggaaaagctcggcgaagaattcccgcaggatcccaagatgcagctcatgggcgccatcaaggctgttttccgctcctgggataacccccgcgcgatctactaccgccgcatgaacgatatcccctccgactggggcactgctgtcaacgtccagtccatggtcttcggcaacaccggcgacacctccggtacgggcgttgcgttcacgcgtaacccggcgaccggcgaaaagaagctctttggtgagttcctgatgaacgcacagggcgaagacgtcgtcgcaggcgtccgcaccccgcagaccatcgaccagctggccgaggtcatgcccgaggcttacaagcagttcaccgatatctgtgccaagctcgagtaccactaccgcgacatgcaggacatggagttcaccatcgaggataagaagctctacatgctccagacccgtaacggcaagcgcaccgctgccgccgcgatgaagatcgcctgcgacctcgtcgacgaaggcatgatcaccgaggaagaagccgtcgccatgatcgacccgaagagcctcgacgcgctgctgcacccgacgttcgacgcggccgctctcaagaaggccaaggtcatcggcacgggtcttgccgcctctcccggcgctgcctgcggcaaggtcgtcttcacggcagagactgcgaccgacatggccaaggccggccacaaggtcattctcgtccgtctggagaccagcccggaagacatcgaaggcatgcactacgcgcagggcgtcctgaccgtccgcggcggcatgacctcccacgcggctgtcgtcgcgcgcggcatgggcacgtgctgcgtctccggctgcggcgcgatcaagatggacgaagccaacaagaagtttgagctcggcggaaagacctacaaagagggagactggatctccatcgacggctcgaccggcaacatctacggcgaaaagatcaagaccgctgcggctgccatctcgggcgacttcaaccgcatcatgaactgggcggatcagttccgcgttctcgatgtgcgcacgaacgccgacaccccgaacgacgctgcgcaggccttcgctttcggcgcgcagggcatcggtctgtgccgtactgagcatatgttctttgaagctgaccgcatcaaggcgatgcgcgaaatgatcgtctccgagacctctgagcagcgcgaaaaggcgcttgccaaactcgagccgatccagcagagcgactttgaggccatctacgaggctatgaagggccgtcctgttaccattcgtcttctggacccgcccctgcacgagttcgtcccgaccgacccgaaggacattgaagagctcgccaaggaaatgaacatctccgtcgagcatctgaagcaggtcatttccagcctccatgagtttaacccgatgatgggtcaccgcggctgccgtctggatgttaccttcccggagatcgcaaagatgcagactgctgcgatcatcaaggcagcgctggctgtccgcagccgcagacctgcatggaagatcgttccggaaatcatggttccgctggtaggcgaagagaaggagcttgcgttcgtcaagtccgtcatcgaccagaccgcaaagaagatcatcaaggctgccggttccgacatgacctacaaggtcggcacgatgatcgaaattccgcgcgctgcgctgaccgctgacgcaatcgcgaaccaggctgagttcttctcgttcggcacaaacgatctgacccagatgaccttcggcttctcccgtgacgacgcgggcaagttcctggcgtcctactacgacaacaagatctacgaatccgatccgttctccaagctcgaccaggcaggcgtcggccgcctcgtcaagatggctgcggagctcggccgtcagacccgcccggacatcaagctcggcatctgcggcgaacagggcggcgatccctcgaccgtcgaattctgccacaacatcggcctgagctacgtctcctgcagcccgttccgtgttcccatcgctcgcctcgctgccgcgcaggctgcgatcaaaaacgcgaggaaataa

SEQ ID NO: 2304 - DNA, 1287 bp, Unknown
  Artificiall/Consensus sequence
atgatgaagaacatgaagaagttattctgcttcgcgctggcagtcgtcatgctgctgagcgttatggcaggctgcgcggccaagaccgagcagagctccagcaccacacaggcaagcgaatccaccgcatccaccgagaccgcatccaccgagaccgcttccaatgaagccgctgacgcttccgatgcagccgcgaccgacggcgagatcgacattgcgttcatcggcaacaccaccggtgactacgcacagtacggcattcctgtccgcaacgctgtgatgttgtacttcgaccagctgaacgctgccggcggcatcaacggcaagaaggttgttgtcaaggaatatgacgacaagggcgacggcgtcgaggctgtcaacgcttacaaccttgccaaggaaaacggcatcaccgctgtcatcggctctgttctgaccggcgcgaccatcggccttgccgacgcgacctatgaagacaacatgccccagatcaccgcttccgctaccgcaaccggcgtaacggttatggaagacaccggcgaggtccgcacgaacgtgttccgtgcctgcttcatcgatccgttccagggtcagaagatggcggattacgccgttgaaaagctgggcgccaagaccgccgcgatcttctacgaaaccggcagtgactactccgaaggtctgaagaacgcattcgtcgttgaggccgagcgcatgggtcttgaaattgtcgacaccgaggcgtttgctaccggcgacaaggacttcaaggcacagatgaccaacattgcttccaagaaccccgacattgtcttctgcccgatctattacggtgaggctggtcttgctatccaggctgcccgtcaggcaggctgcaccgccaccttcctcggcggcgacggcttcggctccgtcaaggattatgcttctgcagaagaactcgaaggcagcgtctactgctctggctacgcgcccggcaccgaagacgttgcacagttcgaaaaggactactgcgagaccttcggcgtggaagaagtccccaatatgtttgcgcctcttgcttacgatgcatccatgatcatggcttacggtctgaaggctgcggaagacgccggcctcgaggctggtacggacgagtacaagcaggctgtcattgacgccatcaagaccatggacggcgtgaagggcattaccggtacttattccttcgactccgacaacaaccccatcaagtccgttgcgatcatcgagctgaccggcggcgaggaagtcttcaaagaaatgttctaa

SEQ ID NO: 2305 - DNA, 1554 bp, Unknown
  Artificiall/Consensus sequence
atggaatttaatacgttaagcctcatcctttgcatcgcactggtcgtggtcggcgcggtctgtttcttcatcggcatgacctatcgcaagaaggtcgcggagaaggaaatcggaagcgccgaagaagaggctcgccgcatcatcaacgagtcgatcaagggcggcgagagcaagaagcgcgagatgctgctcgaagcaaaggaagaaatccataaatcgcggaacgagtacgaaaaggaagtaaaagagcgcagaagcgagctccagaagcaggagcggcgtctccagcagaaggaagaatcgctcgacaagaagctcgaccttcacgagaagaaggaagacgagctcgccaagaaagccgccaacatccaggcgcagcaggaagaggtcgcaagcctcaagcgcagccagatggagatgctggaaaaaatctcgggtctgacgcaggaagaagcgaaagcctacatcctcaagggtgtagaggacgacgtgcggcacgaaaccgccgtcaagatcaaggaaatcgagcagcagctcaaggacgacgcggactctctggcgcgcgagatcatcaccaccgccattcagcgctgcgcagcggaccatgtggccgaggccaccgtttccgttgtgccgctgccgaacgatgagatgaagggccgcatcatcggccgcgagggccgcaacatccgcaccctcgagaccatcacaggcgtcgacctcatcatcgacgacacgcccgaggccatcaccgtttcgtcctttgaccccgtgcgccgcgagattgcgcggctggcgcttgaaaagctcatcgccgacggccgcatccatccgacccgcattgaggatatggtcgaaaaggcgcgccgcgaggtcgaccacacgatcaaggtcgaaggcgaacgcgcgagtttcgaaaccggcgttcacaacctgcatcccgagatcatcaagctcctcggccgccagaaataccgcacgtcctacggccagaacgttctgaaccactccattgaggtcgcccacattgcagggcttcttgccagcgagctgggcgtggacgtgacgcttgccaagcgcgcgggacttcttcacgacctcggcaaggccgtcgaccacgagatggaaggcagccatgtccagctgggcgtggagcttgcgaagaagtacaaggagagccccgtcgtcatcaacgccatcgaggcgcaccacggcgacgtggagccgcagaccatcatcgcctgtctcgtgcaggcggccgacgcgatttccgccgcacgccccggtgcgcgccgtgaaaacgtcgaaaactacatccgcaggctcgaaaagctcgaagagctcaccagctccttcccgggcgtcgaaaagtcctacgccattcaggccggccgcgaggtccgcatcatggtcaagcccgaagaggtcagcgaggacaacatggtcctgctggcgcatgatcttgccaagaagatcgagtccgagctcgaatatcccggacagatcaaggtcaacgtcatccgcgaaaccaaggccgtcgaatacgcaaagtaa

SEQ ID NO: 2306 - DNA, 1281 bp, Unknown
  Artificiall/Consensus sequence
ttggcaattgaatgggaaaaggaaaatcggagggaaagttttatgacattattcgaaaagcttttgggccatacgctgattacagcagacaacatctggggtctgatgggcgtcatgtgtatcggcgtcgcgctgtccatcttcctcgagcagaaataccagtgggcttccaaagtctccggcgccatcatcgcgctgatcatggccatggtgctcgcaaacctcggcgttatccctaccaactccgcgctgtatgacgatatcgtctggggcgttatcgttccgatggcaatcccgctgctgcttctgcagtgcaacctcagccgcgtctggaaagacacgggccgcatgctcatcgtcttcctgatcggcgcggtcggcacgattgtcggcgcgttcatcgcttactacgttctgcgcggcccgttcggcgatgcgcagggtcttgcaaaggtcgcttccatgatgaccggctcctatatcggcggcggcgtcaacttcgcggccatggcctcccagtatgctgccggtgacgacctcactgctgccgcgaccgtcgcggataacctgctgatggcagcttacttcttcgttctcatcgcttgcgcgggctccaagttcttccgcaagcacttccgtcacccgcacatcgaagaggtcgaggcgggcgcctccaaggaagctgcgcagacgcaggctgctgcgttctggagccgcaaggatatctccctgaaggacattgcgtataactttgcttacgcgatcgttgttgtctgggtttcccgcatcattgccggcctcttctccggcttcgcgggcaacgcgttcctcgacttcatcggcaagttcctcggcagccagtacgtctggatcaccacgatctccgtcatcgttgcgaccttctgccacaagcaggttgaaaagatgcacggctcgcaggaaatcggcacctacctcatttacctgttcctgttcgtcatcggcgttccggccaacatcatgaccgttctcacgaagtccccgctgctgctcgtcctgacggcgatcatggttctcgtgaacatgctgttctgcttcgtgggcgcgaagatcttcaaggcttctctcgaagactccatcatcgcttccaacgccaacatcggcggcccgacgactgctgctggcatggcgatttcccagggctggacgagactcgttggcccggctatgctggtcggcgtgctcggctatgtcatcggcaactacgccggtacgattgtcggcattattctcggcgcataa

SEQ ID NO: 2307 - DNA, 1854 bp, Unknown
  Artificiall/Consensus sequence
cggcaaaagtggttgacagagaacgccgcaggtcatgtttctggcaattgttttttgattctgaatggaggctatgttatgtattattccagcggcaactatgaagcgtttgcaagacccaagaagcccgagggcattgacaagaaatcggcctatattgtcggcagcggccttgctgctctgacggcggcctgctatctcgggcgcgacgcgcagatgaagggcgagcgggtgcatattctggagaagggcgatcttgccggcggcgcgtgcgacggatataagtttgagaacctcggctacgtgatgcgcggcggccgcgagatggacaaccatttcgaggtcatgtgggacctgttccactcgatcccgtccattgagaccgagggcgtgagcgttctcgacgagtattactggctcaacaaggaggaccccaactattctctttgccgcgccacggaaaagcgcggacaggacgcgcacaccgacggcaagttcgacatctccgacaagggtgcgatggagatcatgaagctgttcttcacgccgaacgaggagcttcaggacaagaagatcaccgattactttgacgatgaggtcctgaactcgaatttctggctctactggagaacgatgtttgcctttgaaaactggcacagcgcgctggagatgaagctctacattcagcgctatatccaccacatcggaggtctgcccgacttcaaggcccttcgcttcacgaagtacaaccagtatgagtcgatgatcctgccgatggtgaagtacctcgagagctacggcgtgcagttccatttcggcacgcaggtcacgaacgtgatctttgactgccgcgacggcaagaaggccgcaaagcgcatcgaaatgattcacgacggcaaggaagacggcattgaccttacggaaaacgatctggtcttcatcacgaacggcggctgcgtggaaaattcctcgatgggcagccagaacatgcccgcaacgtacaacaccgagctcaaacctggcggcggctgggacatgtggcgcaagatcgccgcgcaggatcccgcgttcggccatcccgacaagttctgctccgaccccgagaagacgaactggatgagcgcgacagtcgaaacgctggacgaccgcatcattccctatatcaagaagatctgcaagcgcgacccgtttacaggaaaggtcgtcaccggcggcattgtcaccgtcaaggattcaaactggctcatgagctggaccatcaaccgccagccgcagttccgcgagcagccgaaggaccattgcctcgtctgggtctactccctcttcaccgacaagcccggcgatttcatcaaaaagcccatgcgcgagtgcacaggcaaggagatctgcatggagtggctgtatcacatcggcgttcccgagggtgaaattgaggagctggccacgaacagcgccaacaccgtgcccgtcatgatgccgtatattgatgccttcttcatgccgcgcgcttacggcgaccgcccgaaggtcgtgcccgacggttctgtgaacttcgccttcctcggccagtttgcagagactccgcgcgatacgatcttcacgaccgagtactccatgcgtaccggcatggaggctgtgtacacgctttgcaacgtcgaccgcggcgtgccggaggtctggggcagcgtctatgatgtgcgtgcgctgctcgatgcgaccgtcaagctccgcgacggcaagaaggccaccgatctgaagatgggccttgccgaaaagatcgccgtcaaaaaggcgctcgagaaaatcgagggcacggatattgaaaagctcttgaaggaatatcacgtcatttaa

SEQ ID NO: 2308 - DNA, 1530 bp, Unknown
  Artificiall/Consensus sequence
aaaaggagagtgggacgattggaagagctgcttcgcatggagcacatcagcaaacggttcggcaatttctatgccaatcaggacatcaatttctcggtcgcaaaaggtgaggtacacaccctccttggagaaaacggcgcgggcaaatcgacgctcatgaacattctcatcggcctctaccagccgaccgagggcaagattttcctcaatgggcaggaggtccgcatcgattctcccagtcaggcggtcaagctcggcatcggcatggtgcatcagcacttcatgctcgtcgaggcaatgacggtgttcgacaatatcatcctcggcgacaagcacgcaaagggcgtcttcatcgaccgcgccgcgcgccggaaggaaattgaagcgctgtccgaaaaatacggcctcgacgtgcagctcgacaagcttatcacggatatttccgtcggcgagcagcagaggaccgaaattctcaaggcgctctaccatggggcggagctcctgattctcgacgagccgtcggcggcactgaccgatatcgaggtcgagggcctgtttgcaatcatgcacaagctgattggagaaggaaaatccatcatctttatcagccacaaaatgcgcgaggtgctgcgcatttccgatcgtatcacgatcctgcgcctcggcaaggtcgtcggaacggtcaatcgcgcggataccgacgggcagaagctcgcaaacctcatgatcggcaaggagctgaccgagtcgcagtatgaaaaaatcgacgcgagcggtgcagaggtcgtggccgagctcgatcatgtggatttcaacaaggaaagcaagcacagcggtctgagcgatttgtccctgaaaatccatgcgggtgagattgtcggcgtggcgggcgtagacggaaacggccagacgcagctggcccagctcattaccggcgttctcgcgccggatgcgggcgaggtccatctcaagggaaagcgtgtcgcggtctttgacccaaacggctttattgagcacggcgtgtgccatgtgccggaggaccggaatttgcaggggctgatcggcgacatgtccatcgcggaaaatctggtcctcaaggatgcggacgacgcgcggtttagtaagggtcacggtctgcttctgaaaaagcgtgccatcggcgattatgccaggcggatggccgaaaaatacgacgtgcgctgtacgtctgtcgaccagagcgtgcgctcgctttccggcggcaaccagcagaaggtcattctcgcgcgggagctggagaacgatccggcgctgcttgttatggcgcacccgacgagaggcttggatatcggcgcgacgagctttgtgcatgagcagatgatcggcgcgcgcgaaagaggcgtcggcattttgctcatcagcgcggacttcgacgaaattctcgagatgtccgaccgcattgtcgtctgctttgaaggcaggattatgggcgaattctccggcaagaacccgccggtggaagaaatcagccttgccatgaccggcaagtga

SEQ ID NO: 2309 - DNA, 1374 bp, Unknown
  Artificiall/Consensus sequence
atggtgatcgcgtcgcttgcgctggtgtttctgaatatctattcggcgagcaacacgcgcgagctgatgtttcaggccaaatacgcctcgatgcaggacaaaattcaggtcgttgcgtcgtcgtttgaaacggcggacacgctcagcgcggagacggtcgatcaggttatttctgttctcggcgatatcaacgtcagcaggctccttatcaccgacggcgaggcgaaggtgctctacgattcgtccgtccggcagaacgccgtggggcagtatgcgcttctggaggcggtcgtgcaggcgctgggcgggagcgacgtgttccactgcgcgtatcacgcgggcgcgctgcaaagcttcgcagcggttcctatcatgtcgcgtgcaacgccgatcggctgcgtgtacgtgatggattttgatgcggagcagggcgagatcatcgaaaacctcgagcggaacattctgcgcgggtcgtggatcttgctcggcggcattgtcgcatgctcggcgattttctctgtcgtcagctccaagcgcatgcgcaagatcctcatgtccatgcgccttgtccgcgagggcgaatacagccacaaaatccagatgcgcggcgacgacgaatatacaacgctcgccaccgagttcaataagctcaccgaccgcttgcaggagtccgaggcgacgcagcggcagtttgtatccgacgcgtcgcacgagctcaaaacgccgctggcctccatcaagctcctgtccgactccattttgcagaacgatatggacgcggacacgatgcgggagttcgtcagcgacattggaaacgagtcagaccgcctgacccgcatgacgcagaagctcctgacgctcagcaaggccgacgcgcagacgacttgcgagcatgaggtggtcgatctgggcgaaacggtacgccgggtgttccggatgctcgtgccgctggccgaccggacgcagatccagctgacggcaagcttagacaggggctgctatgtgctctcgatggaggacgacgcgtatcagatcatttttaacctcgttgaaaacggcatcaagtataaccacgccgggggaagcgtccatgtgacggtccgccacacgcaggacgaagcggaacttctggtggaggatacgggcatgggcattccgcaagacgccatcgagcacatttttgagcgcttttaccgcgtggataaggcacgctcgcggcaggcaggcggctcgggacttggactttcgatcgtccatgagctggtagagcggaatttcggaacgatcgaggtttcctccaaggaggaggaagggacgaaatttaccgttcgcatgccgtattttgagctggaggaggatgacggcgatgcgtag

SEQ ID NO: 2310 - DNA, 1887 bp, Unknown
  Artificiall/Consensus sequence
atgaaaattgaaacgagagaggctttgaacgcccgccgtgagcaggcaaaggcatggctcgccgctgagcagcgcgtgattctcgtctgcgccggtaccggctgtatcgcgggcggcgcgatgaaggtttatgataagcttcaggagctttgccaggagcggaagctcaagacccgtgtggcgctgcgcgaagagggcggcaaggacacgctccacttcaagcgaagcggctgtcagggcttctgcgagatgggtccgctgattgagatccagcccgaaggcattttctatacccatgtccatccggaggactgcgaggagattctcgaaaagaccatcctccacggcgaagttatcgagcgccttctgtacaagctcacagacaccacctacgtcaagcacgacgatatccccttctataaaaagcagaaacgcgtcgttctcgagaccagcggcaacaccgacgcggaagacttggacgaatatttggcacacgacggctatgcggccttggaaaaagcgctctttgacatgacgcccgccgagatctgcgcggaggtcgtggactcgggtctgcgcggcagaggcggcgcgggcttcccgaccggcaagaagtgggaaagcgtccgccggatgcctgagggcaagaaatacgtcgtctgcaacggcgacgaaggcgaccccggcgcgttcatggaccagtccatcatggagggcaatccccacgcgattctcgagggcatgatgatcgcaggccgcgccgccggaagcgacgagggctacatctacgtccgcgcggagtatcctttggcggtcaagcgccttcgcatggcaatcgccaaagcggaagaagctggttttctcggcgagaatattctcggcagtggtttcagcttccggatcaatatcaaccgcggcgcaggcgcgttcgtctgcggcgaaggcagcgctctgacggctgcgatcgaaggccgccgcggcatgccgcgtgtcaagccgccgcgtacggtcgagcagggcctctgggcgaagccgacaatcctcaataacgtcgaaacctttgcctgcgttcccgtcattgtccggcgcggcagcgactggttccgcaccatcggcacggaaaagagccccggcacgaaggccttcgcccttaccggctgtgtggtcaacaccggccttatcgaggttccgatgggtacgacactgcgcgagattatcttcgatatcggcggcggcatcaaggacggcaagaagttcaaggctgttcagaccggcggccccgcgggcggctgtctgacggaagaccagctcgacctccccgtcgacttcgactccctcaaaaaagcaggcgcaatcatgggatccggcggccttgtcgtcatggacgaggatacctgcatggtcgagaccgcccgcttcttcatgaacttcacccagagcgaaagctgcggtaagtgcgtaccgtgccgcgagggtacgaagcgcatgctcgaaattctgacgcgtatcgtggaaaataagggctcgcttgaggacctcgacatgctcgaaaacctctcccagaccatccgcgagacggcgctctgcggcctcggtcaggcggcgtgcaaccccgtttccagtacgctcaaggcgttccgcaacgaatatcttgcccacgtggtcgaccaccactgcccgatctgcaacgggccgaaggcgcatctggccatcgatccggaaaagtgcaagggctgcggcaagtgcaagaaaaactgcccgatggacgcgattgagggcgagaagaagaaaccgcataccatcgatccgtccaagtgcatcaagtgcggtgcgtgccagtccggctgcccgttcgatgccattgagcttgtgaaggaggagggttaa

SEQ ID NO: 2311 - DNA, 1374 bp, Unknown
  Artificiall/Consensus sequence
atgaaaattgtgattgtcggcgacggcaagatcggaagcacgctcgccgagcagctctcgcgtgaggggcacgagataacgatcattgaccgcagcggcgagcccttgcagcagacgagcgaggacttggatattctgtgcgtcgagggaaacggcgcgacatatgccacgcagatggaagcaggcgtggattctgccgaccttctcatcgcggtgacgatgtcggacgagctgaaccttctttgctgcctcgtcgcaaagaaaatcggcgcgcggcacacaatcgcccgcgtccggaacccggagtatagcggcgaactctcgctcatctcggacgatctggggctgagcctttctgtgaaccccgagcttctgtgcgcaacagagatcgctcggacgcttcgtatcccgtcggctatcaaaacagatacgtttgccaacgggcatgtggaacttttaaaggtgcagatcccgcaggactcccttatcgcgggcaagacgctcatggagcttccgagcctcgtgaaggccaagattcttatctgcgcggttgagcgcggggagcaagaggtctatattccctcgggctcgttccggctggaggcgggcgaccgcatctcgttcgttgcgtccatccgcgacgcgcaggcgtttttccaccagatcaagctcgcctcgtcccgcgtgcggacggtcctgatcgtcggcggcgggcacattgcgtattatcttgccaagcagctgacggacctcggcgttggcgtcaaaatcacggaggtcaactatgagcggtgcttgcagctctcgtcgcttcttcccaaggccgagattctgcatggcgacggcacaaacgaaggcttcctgcgcgagtgcggcgttgcccagacggacgcgtttgccgcgctgacgggcattgacgaagaaaacgtcctgatggggctttacgtgcgcaaaaccttcccgaaggtcaaggtcatcacgaaaattaaccgctattccttccagtcaatcatcgagacgatggatcttggaagcgtctttaatccccggttcagtacatcgaacgtcatctgccggtacgcccggtccatgcagaactcgctgggctcgaacgtcgagacactctacaagctcgtcggcggcaaggcagaagccctggaattccgcgtggccgaaggctccgccgtctgcggcattccgctgcaaacgctccggctccggcagaatcttctcattggctgcatcaaccgcgccggaaaaatcctcatccccagcggccaggatacgatcgagccgggcgacacggtcgtcgttgtgacaagcgttacggggctcaacgagctcgacgacattctcgaaaagcacagagggtaa

SEQ ID NO: 2312 - DNA, 2487 bp, Unknown
  Artificiall/Consensus sequence
atggaaaagcaaattaaaattgcccttgcgggcaacccgaactgcggtaaaacaacgctgttcaacgcgctgacgggttcgaaccagttcgtcggcaactggccgggcgtcacagtcgaaaagaaggaaggcaagctcaagaagcatgacgacgtcgtcatcatggaccttcctggtatctactccctttccccgtacaccctcgaggaagtcgtcgcccgtaactatctgatcaccgagcgccccgacgccatcctcaacatcatcgacggcacgaacctcgaacggaacctgtacttaacgacccagctgaccgagctcggcatcccggtcgtcatcgccatcaacatgatggacgtcgtccgcaagaacggcgacaagatcaacaccgcagagctcagccgcgagcttggctgcgagatcattgagatctccgctctgaagggcacgggcatcatggaagcagccgaagctgccgtcaaggccgccaagagcaccaagaccgtcccgatgcacactttctccggcccagtggaacacgcgattgcccacatcgaagaggccgttgtccacaatatgcctgaagagcagcagcgctggtacgccatcaagatttttgagcgcgacgacaaggtgctcgaaaagcttcaggtcccggctgacgtgatggcccatgtcgagcaggacatcaaggcggcggagcaggagctcgacgacgacgccgagtccatcatcaccaacgagcgctacgtctacatcgcagagctcatcaagaactgctacaagaaaaagaatgtgggcggcctgtccacctctgataagatcgataaggtcgtcaccaaccgctggctcggtcttccgatcttcgcggtcgtcatgttcctggtttactacatctccatggttaccgttggctcggccgcgaccgactgggcaaacgacggcctgttcggcgacggctggcacctgctcggcatcggctcctccgcttatgcagacgcatccgatgaatatgcagcagcaagcgacgctgtcagcggctactatgagctcgacaccgaagccgaagacttcgatgctgacgcagctctggccgacatgaaggcggttacgcccgattctgagaccgcaaccatcgaggttgaagacgaggaaaccctcgccatcagcgatatgacggtctactactccgaagttcccgcaagcgaagaagaaaacgaagacgttgtgcagatgtcctatctcgacgctgtgagctacttcgaagaaaacggctttgacgagccagaccccgctgattatggcgtttgggtccccggcgttccggttctcattggcaatgccctcgaagctgccggcgcggcggactggctgagcggcctgatccttgacggtatcgttgccggtgtcggcgcggtgctcggctttgtgccgcagatgctcgttctgttcctgcttctcgcgttcctcgaggcctgcggctacatggcccgtatcgccttcgttcttgaccgtatcttccgcaagttcggcctttccggtaagtccttcatcccgatgttaattggcaccggctgcggtatcccgggcgttatggcctcgcgtacgatcgaaaacgagcgtgaccgtcgtatgacgatcatgaccaccacctttattccctgcggcgcgaaggttccgttcatcgcgatgatcgcgggcgctctgtttggcggcagcgcatgggtctccacctccgcgtactttatcggcatggctgcgatcatctgctccggtatcatgctgaagaagaccaagatgttctccggtgatcccgctccgtttgtcatggagctcccggcttaccactggccgacgcttggcaacgttctccgctccatgtgggagcgcggctggtcgttcatcaagaaggccggtacgatcatccttctttccacgatctttgtctggttcaccacctacttcggctgggttgacggcgcgttccgcatgctcgacgagagcgagatcgactactccatcctcggccacatcggctccgcgatcgcctggattttcgctccgctcggctggggcaactggcaggcagttgtcgcgtccatcacgggccttgtcgcaaaggagaacatcgtcggcacgatgggcatcctctacggcggcggcgacggctcggtctatcaggccatcggcaatgccttcaacggcatcaccggctactcgttcctggtctttaacctgctgtgcgctccttgcttcgcggccatcggcgccatcaagcgcgagatgaacaacgcaaagtggacgtggtttgccatcggctatcagtgcggctttgcttacatcgttgcgctgatgatcaaccagttcggcggtctgttcaccggcaacgtcaacgttcttggtctgattgcggctgtcatctgcctgggcttcatcgtctacatgctcgtcaagccctacaaggaagctaccaagctgaaggtctaa

SEQ ID NO: 2313 - DNA, 1845 bp, Unknown
  Artificiall/Consensus sequence
atgtactgcgtcaaaaaaatgaccgatgatctgtactgggtcggcgcgagcgaccggaggcttgcgctgtttgaaaacgtctaccctatctcgcgcggcgtgagctacaactcgtatctgctgctcgatgaaaagacagtgctgctggataccgccgacagctcggtgagcggcattttctttgaaaacgtcgagcacgtgctcgccggccgcccgctcgactatctgatcgtcaaccacatggagcccgaccactgcgcgctgatgcaggacctcgttctgcgctaccccgatgtgaagatcgtctgcaataagaaaacgctcgcgatgatcgaaaacttcttcacgttcgacatccagtcccgcgccgtgatcgttggcgagatggacacgctctgcaccggacggcacacgttcgcgttcgtcatggcacccatggtccactggccggaggcaatggtgtcctacgatgtgacgacgaagacgctctactccgccgacgcgttcggcaccttcggcgcgctgaacggcaacctgtacgcagacgaggtaaacttccagaccgaatggctcgaggacgcaagacgctactacaccaacattgtcggcaaatacggcacgcaggtacaggcacttctgaaaaaggccgcgacgattgaaatcgaaaccatctgcccgctccatggccccgtgtggcgcaaggacatcggctggttcatcgacaaatatgtccactgggcaacctacaagcccgaggagcaggccgtcgtcatcgcctacgcctccgtctacggaaacaccgaaaacgccgcgaacattctggcatctaaattggccgatctcggcgtgcgggacgtcaagatgtacgacgtgtccgcgacgcacccgagcttcatcgtctccgagtgcttccgggcaagccacctcgtcttcctttccaccacctataacgcgggtatgttcgtgaacatggagaatctggtccacgacatcgtgaaccacaacctccagaaccggaccatcgccctggtggaaaacggttcgtgggcccctaccgcgggcgggctcatgcgcgccgagttccagaagctcaaaggctgcacgattctggacgaaacgctcaccatcaagtcctccctcaaggaaaaccagctggatacgatggacacgctggcgcaggcgatctatggcagcatggatcatcccgcgcccgccgtccatgaggaggccaagcctgtcgagcagaacgcgatgttctcgctttcgtacggcctttacgtcctcaccgcgcgcgacggcgagaaggacaacggctgcatcatcaacaccgtcatgcagcagaccgatacccccaagcgcatcagcatcacggtcaacaaggcgaactacacctgcgatatgatcaagaaaaccggcgtcttcaacgtctccgttctctcgcaggacgcgccgtttgcgatgttccagcactacggcttccagtccggtcgggatgtcgacaaatttgccgacgcgaagaccactccgcgcgccatcaacggcgtttattacgttccgtattgcacgaaggcgtttttgtccggcaaggttgtgcagacggtcgagtttgagacgcatgtgctcttcatcgccgatgtgaccgaggcgcgcgagctctcgaacgtccccgccatgacctacagctactactttgaaaacgtcaagccgaagcccgccgccctcgccgagcagaagggctgggtctgcaagatctgcggctatgtctatgagggcgaggacctccctgccgacttcatctgcccgctctgcaagcacggcgcagaagactttgagaaattaggctaa

SEQ ID NO: 2314 - DNA, 1515 bp, Unknown
  Artificiall/Consensus sequence
atggagaatattacaaagcggtttggaaaggtgacggccaacaacgccgtgaacctggagctgcacgagggcgagatcctgtctttgctcggcgaaaacggcagcggcaaaacaacgctgatgaacatgctctccggcatctacttccccgatgaggggcaaatctacattcacggggaacctgtcacgatcggctctccgaaagatgcctttgctcacggcatcggcatgatccaccagcacttcaagctcgtcgatgtcttcaccgccacggaaaacatcatcctcggtctggacgagcccggccggatgaacatccccgaggcgacccgtaaagtcaaggagatctgcgacaaatacggcttcgacattgaccccaaccagaaaatttacgacatgtccgtctcgcagaagcagacggtcgagatcgtcaaggtgctctatcgcggcgcggatattctgatcctagacgagccgaccgcggttctgaccccgcaggagaccgacaagctcttccagatcatgcgcaacatgaaatccgacggcaagtcgctcatcattatcacccacaagctccatgaggtgctcgacgtctctgaccgcgttgcggttctgagaaaaggcgagtacatcggagatgttctgacaaaggacgccgatcagcagtccctgactgacatgatggtcggccacgcggtcgcgctgaacatcgaccgtccggagcccgtaaacgtagagccgagactggtcattgagggcctcaccgcctacgatgagcttggcgtcaaacgcctcgacgacgtgtcgttcaccatcaacgccggcgaagtcctcggcatcgcgggcatcgcaggcagcggccagagagagcttctcgagtccatcgcgggtctttaccccgtggccgaaggctccatccagtattacgctcccggcgcagacaagcccaagcagctcgtgggcctcgaccccatgaacatccgcaaaaacggcatcgccatgtcgttcgtccccgaggaccgtctgggtatgggcctggtcggctcgatgggcatgacgggcaacatgatgctccgttcgtggcgcaagggcgcaagcatcttcttaaaccgcaaggaccccgaggcgcttgcaaaccgcatctggaacgagctcggcgtcgtcacacccagcacgaacttccccgtccggcgcatgtccggcggcaacgtgcagaaggttctggtcggccgagagatcgcgcagtcccctgccgttctgatgactgcctacgccgtgcgcggcctcgatatcaacacgtcctacaccatctataatttgctaaccgagcaaaaaatgcgcggcgtcgccgttgtgtatgtcggcgaagacctcgacgttctgctcgagctgtgcgaccggattgtcgttctgtgcggcggtcaggtttccggcgtggtcgacgcgagaaccaccgacaagcgccagatcggcagcctcatgaccctcgtgagaggaggaaaagtcgatgcataa

SEQ ID NO: 2315 - DNA, 1257 bp, Unknown
  Artificiall/Consensus sequence
aaagtatttatgaacaagaagtctgttgcccagaactatacgttccttggcatcatgctcggcgccatgattctcggcgcgctgtttggctggctcgccccgtcggcagcggtggccatcaagccgctcggcacggtgtttatcaacatgatgttctgcatcgttgtgccgctggtgtttgcgtcgatctccggcgcggtcgccaatatgaaaagccgcaagcgcgcgggcaagattatgggtacgacgattgcaacgttcgtcgtgaccggcgcgattgccgcggtcatcatgttcctgctcgttcagctgttcccgccggtgctcacgccgtggacggagcttcaggccgaggaaatgggcgagtacgcaaccatcagcgacatgatcgtcaatttcttcacaacctctgacttcgtgggcctgctcagccgccgtgcgatgctgccgctgatcgtgttctcgatcctctttggctttgccgtcaatctcaacggcggcagcgagacgctggtcgcaaagttcctggaagacctgacgaacgtcatgctgaagtttgtcaagatcgtgacctactacgcacccatcgcgttctttgcgatttttgcagaccttgtcgcaagctacggcccgcagatcaccgagtcctatggccgggcgctgctgctgtactacccgctgtgcgttgtgtacatctttacggctttcccgctgtttgcctggttcggcggcggcaagggcgctgtgaaggtcatgttccagcacattgtcaagcccgcagtcgtatctctcggcacgtgctcgtccgttgcgacgatcccgaccaacatggaagaggcagaagccaccggcatctccaaggacgtatccgacatggtgcttccccttggcgcgacgatgcacatggacggctcgtgtttctcgtgcgtgctgaaaatcgcgtttgtactcggcgtgttcgggcaggatatgggctttgagcgtctgatcccgatcgttctggtcgcggttctgtcctcagtcggcatgtccggcgtgcccggcggcggctacatcggtgagtacatcatctgctcgatcttcttcccgacgcagatggaggttgcgttcccgatcctcgtggccatcggcaacctcgtcgatcctcccgcgaccatgatcaactccgcgggcgactatgtggtatcctacattgtctctcgctttgtcgatggcaaggattggctccagaagcagctggcggccaagaaggactga

SEQ ID NO: 2316 - DNA, 1191 bp, Unknown
  Artificiall/Consensus sequence
atgaagttctccagcaaggtcgaaaaatgcggcctttccccgatgcggaaattccacccctatgcggtggctgctgaagcaaagggaaagaagatctaccacctgaacatcggccagcccgatgtagagacgcccaagcagttctttgacaccatccgtgagttcaatcagcccgttctggaatatgccccgtcccccggtatgcctgttctgatcgatgcgatccagaagtattacgacgatctggatatgcactttgaaaaggacgagattttgattacgaccggcggttccgaggcccttcagatcgttctggagtgcatcctcgacgacggcgacgagattctgatccccgagcccttctatcccaactacaacaccatggttaacacctgcggtgcgcacatccgtcccatccctacctgccccgaggaaggctatcactacgccgaccgcgagaaggtcgaaaagggaatcaacgagcacacccgcgccatcatggtcacgaaccccggcaaccccaccggcgttgtcctgacgccggaagagatgcgcatgatgtgcgatattgccaaggagcacaacctgtttatcatcggcgacgaggcgtatcgtgagtttgtctacggcggtgagccgctgcagtccatgggtgagttcgcagacgctgctgataatgttgtcgttatcgacaccgtctccaagcgcttctccgcgtgcggcgcgcgtatcggctgcatcctgacccgtaatcatgagctcctcggccatgcgctcaagtactgccaggcgagactttccgtcgcaacgctcgatcaggtcgcttcggccgctctgtatcaggttgacccgtcctactttgcggctgtccgcgaggagtataagcgccgccgcgacacggtcgttgccaagctgcgcgagatccccggcgttgtgttcgactgcccgaagggcgcgttctatctgatggccgctctgcccatcgacgacgcggacaacttccagaagtggctgctcgaggagttcgacgacaacggcgataccgtcatgttcgctcccggcgctccgatgtacgcaacgcccggcaagggcaagaacgagatccgtatcgcttacatcctcaagcaggataagcttgagcgcgcgatggatctgctcgccctcggcattaaggcttataacaatagataa

SEQ ID NO: 2317 - DNA, 1491 bp, Unknown
  Artificiall/Consensus sequence
atggcaatgttgttagaaatgcgaaatatttcgaagtcctttcccggcgtaaaggcgctgaatggattttccatcgatttgaaagcgggcgaggtacacgcgcttgtgggagagaacggcgcaggaaagtcgacgctgatcaagaccctctacgggatccatcagcccgatggcggcgagatcgtcatcgacggcgttccgacaaaaatcaacggccccgcggacgcgctgagcaagggcatcggcgttgtgttccaggagctgagcgtctgtccgcatctggacatcgcgaataatatttttcttggctgcatcaaaaataagcacggcgtcatcgacgaccgctttgcccacgaggaagcagcccggctgatggaagaagcggtaggactgcggattccgtctgatacccccatgaaggatctgtcgattgcagatcagcagatggtggagatcacaaaggtcacatccaagggatgcaggatcgtcgtgtttgacgagccgacctcgtccctgaccgaaaacgaaattgaacggctgttcaaaattatttttgcgctgaagaaaaagggcgtgggaatcatctatatttcccaccggctcgaggagcttcccgtaattgccgaccgaattacggtcatgcgggacggcacgcgcgtaaaaaccatggactacaaggatacgaacgataacgagatcatcagcctgatggtcggaagagaattatccaacatctatcctacatataaaagaacgatcggcgaggtcgtctttgaagcggacaatatccggcagggcacaaagcttgacgtgaagcatctggatgtcagaaagggcgagatcctcggcattgcgggccttgtcggcgccggcagaacggagacgcttcgcgcgctgttcggcgcggacgacgcagacgagaagcacgtgaagatcgaaggcaaagagtataccttcaataatccctccgaggccatcgcggcgggcttcgtgtatatgacggaaaaccgaaaatttgacggcgctgcgttgggactgagcgtggaggaaaacatcacgatggcctccctgcagaagttttccaagcgcggcaggatgcaggaggcaaaggcgaagagcaacgcgcaggaatactgcaagaagctcaatatccgcacgccctccatcgaccagaaggtcatgaacctctccggcggcaaccagcagaaggtcatcatcggcaagtggctgacaagaacggcgaaggtgatggtcttcgacgagccgacccgcggcattgacgtcggcgcgaagtatgaaatttattctctcatgaacgatctgtccgatcagggcatcgcgatcatcatgatctcttcggaccttccggagatcctcggcatgagcgaccgcgtcgccgtctttaaagacggccgtgtgaccgcagtgctcgaccgaaaggacgcggactctgaaaccatcatgaaatacgcaaccggaaagctttcgtaa

SEQ ID NO: 2318 - DNA, 936 bp, Unknown
  Artificiall/Consensus sequence
atgaaatatacggtagtagacggccactgcgacacgccgatggagctttggctgcggcaggagaacctgcggagcaatacctgtcaggtatcactcgaacgggccaaaaagctttcgggttacgtgcagttttatgcattctgtacggtgtggctcgaacaggacgggagctttgaagcgcactacgcggccgctttggagcattttaaccgccagctggacgagaacaaagaccagatcgtccgctgcaaaaatgaagcggatgcgcgcgcggccatcgggagcggaaaatgcggtgcgttcttgtcgatcgagggcgcggaggccatttcctgtgaccccggaaaattagagcttgcctgcgcgcagggcgtgcgcatgatcgcaccggcgtggaacgcgcagaatgcgctgaccggaagctgcatgacaggcggaggtctgacggcacagggcaaagaattcgtgcgccgggcgcagaagcttggcatgatcctagacgtcagccatatctcggagaaagcgttctgggatctttgcgacatcacagaaaagccgtttgtggcgagccattccaattcgcgcgccatctgcaagcacgtccgcaatctcaccgacgagcagttcaaggcgttgtgcgaggcgggcggtacggcggggctgaatctctacggcgcatttttacgcgatgagggcaggccgacactggaagacgtctggcgtcatatcgagcattttttggagctcgggggagacggacatatcgcgctcggcggcgatctggacggatgcagcgtgctgccggagggctttgccggtgtggacagctatgcaatgcttgcgcagtggctggaagacaggaagctgccaagcagtacaatagaaaatatattcagtgagtctttattaaaggttgtgaaacaatgcactatgtaa

SEQ ID NO: 2319 - DNA, 1467 bp, Unknown
  Artificiall/Consensus sequence
atgaaaaaaggactgatcattgcgctttgtgtgctgctggtgcttggcgcgggcgcgggttttgcgtattaccggttgtacagcacagcgcaggacgcggagcagatgcagcggacgatttttgagcagtatgaggcgatgctgcaaaacgcagagcagacgacgctcaccgtgacggaaaacggcgagacggtcggcgtgtatacactcgatgcgcttgggcttctcgatgcgacgaagcagacaatcgcagccgggtttacggcagatgaacgcatgaacccggatattttcgatcagaagggtgtgacggaaaagctcgagtggcgcgcgcagacgcacacgcagccgggcacggtccgcgccgatctcgtgcggtacaccgacgagcgggtcgtggatgatttagaggccatgtcccgcagacgggcgcaggacgcgtacatggagtttgacggcgaaaagttccgcgtcgtggatgaggtgcagggaaacgaattggagctcgagcctgtgcgcgcggcgcttcgggaggcggctgcagcgctcacggttgacgccagcgcgccgcagagcgtgagctttgaggtgaccggcgtttccgggtgctacgcgcagccggagatcacggcaaagaacacggattttgactttaacgagcttttgcaggaaaagctggccgatgtctccgtgaagctggacctcaatctcgaggggcagacggagcagaataaaatcgtcacgctgacgcaagccgagcttttgccgcttgtgtcggtggagaaagacggcagcattcaggtcgacgaggacaagctggacgtcctgatcgcgggctggaaggcgctggcggatgtgagcaatacgtcgttcattttaaatacgtatgtggacggcccgaagccgatgggttttctgaaggtcgactatcagctggacaccgagagcctcaagcagacgctcaccgaagcgctcacgacgctgacgtttgacgatatccgcgcgcagctgctgctctataaaaacggcgagccgtatgaaccgcttacggatgtttacgttgaggtcgacatcgacaaccagaagctgacggtttataaagagggcgaggttgtgatctcgaccgacgttgtgaccggcaacctcaacggcttccagacgatcacgggcctttactacgcgtacaataaggagaccgaccagtggatgagcggcgaggactacctcgtgttctcaaaatactggattgggatcgacggcgcgtacggcctgcatgacgcgtcgtggcggacgcacttcggcaaggacttttacgtcaacggcggcagccacggctgcgtcaatatccccgtcgacgcgatgccgacgatctttgagaccgtcgaggtgggtgacgcgatcatcctcttcggtaagaacaagtggttcgagcccgaccccgagaccacaagaattttgcagtcgtaa

SEQ ID NO: 2320 - DNA, 1293 bp, Unknown
  Artificiall/Consensus sequence
ttgattaaatatatcgtgcagggcggaacccgcctgtctggtcatgtcaatatttcgggtgcaaagaacgcggcggtcgcgattctgcccgcgagcttgctggtcgacggcgtttgccgcattgaaaatgttccggatatctcagacgtccggctgctgcttgaaattttaagaaatatgggcgcgaacatccgccgcttcggccggaacacgctcgagatcgactgctcgcacgtgcgcaacgctacggcacccatcgatcttgtgcgccgcatccgcgcttcctactatctcatcggcgcagagctcggacgctttggccacgcgcgcgtcgccatgcccggcggctgcaatttcggcgtgcgtcccatcgaccagcacatcaagggctttgaggcgatgggcgcgagcgtggagcagctgggcggctatgtctgcgcagatgcgcccgaaggcggccttcagggcggccatgtgtaccttgacattgtctccgtcggcgcgacgatgaacattctgctggctgccgttctttgcagcggcatgacgatcatcgaaaactgcgcgaaggagccgcatatcgttgaccttgcgaacttcctgaacgctatgggcgcgaaggtatccggcgcgggaaccgatgtcattaaggttcgcggcgttggccagctgaagggcggcaattacacgatcattcccgaccagatcgaggccggaacctatatggctgcggcggctgccgtgggcggcgatgtgacggtcgataacgtcattccgaagcacctcgactgcatcaccgcgaagctgcgcgagatgggcgcaaaggtcacggagtacgacgacgcaatccgggtcgaagccgaccaccggctccgccgctcgaatgtgaagaccatgccgtatccgggctttccgaccgacatgcagccgcagatcgccgtgtgtatggcgctggccgaggggacaagccttgtgaccgagggcatttacgacaaccgcttccgctacaccgccgagctcaaccgcatgggtgcgagcattcaggtggaaagtaagacggcggtcatcgacggcgtgacgcagctgcacggctgcgaggtgcgtgcgtgcgaccttcgtgcgggcgcggcgatggtgattgcagcgctgtgcgccgagggcacaacgacgattgaggacgcgcattatatcgagcgcggctatgaggacatcatcggcaaattctccgccatcggcggcaaaatccgccgcatcgaaaccttcgaaggcaattcccagagcgcggcaggttaa

SEQ ID NO: 2321 - DNA, 1416 bp, Unknown
  Artificiall/Consensus sequence
ttgaccggcacgcaaaaagtttttctgattcgcgtgcatgtcagtgcatccacaaaatatttaggaggaatcgctgaaatgaaaaagatcattgccctgcttctggcgctggttatggtttttgcgctggtagcctgtgcggctaagaccgacgctcccgctgaggaaaccaagaccgaaaccgcagccaccgaaaccgcaaccgaagaaaagaccgaggaggctaccgaagagcccgccgccgagacgaccgctcccgctgacttcaaggttggcttcatcatgctccatgatgaaaactccacctacgacctgaacttcatcaacggcgcaaaggaagccgctgaggctcttggcgtagagtacgtcatcaagacgaacgttcctgaaggtcaggaatgctacgacgccgctgctgatctggctgacgccggctgcaacatcgtcttcgccgactccttcggccatgaggactacatgatccaggctgccaaggaattcccggatgtccagttctgccattccaccggcacgaaggcgcacaccgagaaccttgccaactaccacaacaccttcgcttccatctatgaaggccgctacctcgccggtatcgtcgccggtatgaagctcaacgagatgatcgagaacggtgagttcactgcggacgaggccaagatcggctacgtcggcgcgttcacctacgccgaggttatctccggctacacctccttcttcctgggcgctcgctccgtctgcccgaccgcaacgatggaagtcaccttcaccggcagctggtacgacgagaccgctgagaaggaaggcgcacagaagctcatcaacaacggctgcaagatcatcagccagcatgctgactccatgggcgctccgaccgcctgcgagaccgccggtgtccccgacgtttcctacaacggctcgaccatagctgcctgcccgaacacctacctcgtttcttcccgtatcgactgggctccgtactacaagtacgcgatctccgctgcaatgaacggcgaagcaatcgacgctgactggaccggcacgcttgcgaccggctccgtcgtcctgaccgagctcaacgagaacgtcgtcgctgccggcactgcggaagccgttgaggctgccaaggccgagctcgaggctggtacgcgccatgtctatgatctgagcacctttactgtcaccattgacgacacgcacaatacctttaagaccgactatctcaagctcgacgatgcaggccacatcacctcttaccttgctgacgtcgactccgatgcggattacatcggcgacaccgaagtcgtgaaagatggttattttgccgaatctgatatgcgtagcgctccgtacttcgatctgcagattgacggcatcacgctgctcgacaccgcattctaa

SEQ ID NO: 2322 - DNA, 1446 bp, Unknown
  Artificiall/Consensus sequence
atgaacaaacggatgattctttacattcagggcgcgattctgctcattgaatcggccatcatggtgcttcccatcgcggcggcgctcatctaccgggagacttcgggcgtctggtttttctacacggcgctggcggcggcgatctgcggctttgcggccatgaagctatctaagccgcggacgaagacgatctacgcaaaagagggcctcattaccgtggcgctgggctggatcgtgctgtccttagttggtgcgctgccgtttacgctctcgggcgaaattccgttttacctggacgcggtgttcgagatgatctccggctttacaacgacgggctcgagcatcctgccgaacgtcgaggcgctcagccgctgcatgctcctctggcggagcttttcgcactggctgggcggcatgggcattctggtattcatgctggccatcgtcaaaatggaaggcgggcagggcatccatctcctgcgtgccgagagcccggggccgacggtcggcaagatggtcccgagaatggtcgactcgtcgaaaatcctgtatacgatctactttgcgctcacgctcgtacaggtggtattttacctggctggcggcatgccgctttttgactcgctctgcaacgcgtttgcaacggccggtacgggcggcttttccatcaaggcagactcgttcgcaagctacagcccgtatttgcagacggtcacaacggtcttcatggcgctgttcggcgtgaacttctcgatctacttcttcctgctgcaaaagaagttcgacctcgcgttcaaaaataccgagctccgctggtacgtgggcattatccttttctccatcgcgatgatcacggcgaacattctgccgatgtacccggacttccacgcggccatccatcacgcggcgttctctgtctcgtccgtcatcacgacgaccggcttcggcacggaaaactttgacctctggccagagttttcgcgcgtgattctggtgttcctcatgatcgtaggcgcgtcggcaggctcgacaggcggtggcctgaaggtctcgcggctggtgattctcgttcgcgcggcgcaggtggaggtgcgcagactcatccgcccgcgcacggtcaaggtcatgcgcatcgacggcaagcccgtagggcaggatacggtgcgcgcggtgagcgggtacctcatcttgtatgtgctcatctgcatggtgtccgtgcttctggtctcgctcgacggcttcgacggctcgacgacggtgacggccgttctcgcaacgttcaataacatcggcccgggcctcggccttgtgtgtcccgcggggaactttgcgatgttcagtccgctggcaaaggtcgttctgtgcctcgatatgctcttcgggcggctcgagatttatccgatgctcgttctgctgctgccgagcacgtggtccaaaaagaactga

SEQ ID NO: 2323 - DNA, 2106 bp, Unknown
  Artificiall/Consensus sequence
tatatgaaatgtcagattctgcatgagtcgcgcgggcggatgcgggtgcacctggtctgcgcgcatatgacgctgcatcaggcagacgttctggagtattatctgaaaaatattgcgggcgttttggatgttaaggtctttgaccgcacgtgtgacgcggtggtcagcttccaagaaaaccgcacagccgttcttcgcgcgtttgccgcgttttcgttccagaaggcggaggcgatagaccttgtcccggcgcacacgccgcgcgctctgaaccgcgagtacgaagacaagctcgccatgaccgtccttcgccgtacgttttccaaactctttctgccgcttcccgtgcgggcggttatctcggccttccgttcggtcaagtatatccgcgaggggctcaaggcgctgctctgcggaaagctctccgtcgccgttctggacgcgaccgccgttacggtctcgatggtacgcggcgatttcgacacggcgggctcggtcatgttcatgctgcgcctcggcgagatcctcgaggagtggacgcacaagaagtccgtcgccgatctcgcgggcgcgatggcactgaatgtcgatcaggtctgggtcaaggcgggcgaaacggaagtgctcgttcctgtctcgtcggtgcaggcgggcgacctcgtcgttgtgcgcacaggcaacctcatcgcgctcgacggcaaggtggtcgagggcgaggcgatggtcaaccagtcgtccatgaccggagagtccatgccgattgtcaagcgcgaaggaagcttcgtctatgcgggcacggtctgcgaagagggcgagtgcgtcttccgcgtggaaaagacgatgggcggcggccggtacgaccggatcgtaaagatgatcgagcagtccgaaaagctcaaatcgaccgccgaggacaaggcctcccgccttgccgataagctcgttccctatacgctgggcggcacggtgctgacgtatctgctgacgagaaacgtcacaaagatgctggctgttctgatggtcgacttctcgtgcgcgctcaagctcgcgatgccgattgcggtgctgtccgcgatgcgcgaggcaagcgcgtctcatatctctgttaagggcggccggttcctagaggccgttgcgaacgcaaacactgtcgtcttcgacaagaccggcacactcacctacgccatgccaaaggtcgccgatatcgtgaccttcgccgattatcaggaagaggatatgctgcgtctggccgcgtgcctcgaggagcactacccgcactcgatggcaaacgccgttgtggaggccgcaaaggagcggggcctgagccatgaggagtaccactcgcaggtgcagtacatcgtcgcgcacggcatttccagcatggtaaacgacaaaacggttctcatcggcagcgcgcacttcgtctttgaagacgagggctgccatgtgccggagggcgaggaagaaaagttccgctcgcttcctgcggagtattcgcacctctatctttgcatcgcgggcaagcttgccgccgtcatctgcatctttgatccgcttcgcaaggaggcggccgacgcagtgcgcgcgctgcatgcgtgcggcattgacaaggtcgtcatgatgacaggcgataaccgtaagactgcagaggccgtcgcggcgcaggtcggtgtggacgaggtctacgccgaggtgctgccggaagacaaggccgctttcatccgcgcggaaaaggccgccgggcgcacggtcatcatgatcggcgacggtgtgaacgactctcccgcactctcggaggccgacgccggcatcgccatctcgacgggagccgcgattgccagagagatcgccgacattacgatcgcctcggaggacctcttcgagcttgtgaccctgcgaaagctctcgaccgagctcatggcgcgcatccgccgcaactaccgcttcattgtgagctttaatttctcgctcatcgtgcttggcgtggccgggattctgccgccgacaacctcggcgcttctgcacaacacgtcgacccttgccatcagcatcaagagcatgaccaatctgctgcctgaaaaatcgcaggcgcacgaaagcgtctga

SEQ ID NO: 2324 - DNA, 1281 bp, Unknown
  Artificiall/Consensus sequence
atgccgacctctgtcattccctacattcccgaaaccatcgtcgtccatctgggcgcgccgacgcaatcggcagcaaatgtgaccgttccgttcacggactacatcaaaaacgtcgtctcgagcgaaatttatcccacatgggagcctgccgcgctggaagcgaacacactcgcaatcatttcctttgccctcaaccggttctacaccgagtattaccgcagccggggctatgattttgacatcacctcgtccacggccatcgatcagaaatacatcgagggccggaacatctatgaaaacatttccgtcctcgtcgatgagatttttgaccggtatttgcggcgcgagggctttgtcgaaccgctggcagcaaaattctgcaatggggtcacgacgacgtgcgacggtttaagccagtggggctcgcagtacttagctgaaggcggcgcggacgcgttttcgatcctccgctcgtattacggcaatgttgagctcgtcacgaatgcgcccgtgcaggagccgtcgccatcctaccccggaacgcctctgcgccggggcgacacaaacgcggacgtggcgctcatccagtttatcctgaatcgcatctctcagaactaccccgccatcccgaagctcaccgtcgacggtgtgtttggttcggctaccgaagcctctgtgcgcgcgctccagtcgattttcgatctgacagcagacggcattgtcggccctgcgacgtggtacaagatgctccttctttatgtcgcggtgcagcgtctttccgagcttcagtccctcgggcagacctacacgcgctataactgggagctgccggagcctctttccattggctcgaccggaagccgggtgacgtttttgcagtatgtgctctccgtgctcgcgcagttcattccgtccatcccggaggcgaacatcacgggcacatactcggaaaacacggaggaagctgtccgcgcgtttcagagctatgcaggtcttcccgcgacgggcaccattgatgacgcgacctggaacgccctttacgcgcagtattctgccatccgaagcgaggttttatcgagcggtgagctgtttcccatcacagagtcagatgcgcccgaagccgtgcctgttttcgccaatacggaagctcccgccccgtccatcttcccgcagcctcccacaggcgatgcggcgcagcgctatacggacacctcgcgctttctgcaatatcccgccggaggctttgccgccggtcagcaagatgaggagggctctttatga

SEQ ID NO: 2325 - DNA, 1587 bp, Unknown
  Artificiall/Consensus sequence
atggtaaataacaatgctccattgttggagatgcgaaatatccagaaggactttttcggcaatcaggttctgacggacatcaaccttacgcttcgcgagggcgaggtgctgggtctggtcggtgaaaacggcgctggtaaaagtacactgatgaaaatcctgttcggcatggacgtcatccgggaaaccggcggctacggcggcgatgtgctgattcatggcgagaaggtctccttctcgacgccgtttgacgcgctcaaggccggaatcggcatggtgcatcaggaattttccctgattcccggcttcacggcgacagaaaatattctgctcaaccgcgaaccgaaaaagagcaacgtggtctccgagatcttcggcgaccgtctcaataccctcgattataagcagatgaacgaacgctcggcggaagccatcaaaaagatgggcgttcacatcgatcagcatatggtcatcagcgacatgccggtcggccataagcaatttacggaaatcgcccgtgagctgagtaaagacaacctcaagctcctcattctcgacgagccgaccgcggttctgaccgagaaagaagcggcggcgctgcttaactccatccgctcgatggccgcgcgcggcatttccgtcatctttatcacccaccgcttgcaggagatcctgtccgtatgcgacaaggtcgtcatcatgcgcgacggcgtcgtggtcaaggataccccggcaagcgaaacgaatgtctccgaaattacgcgctgcatggtcggccgttcggtcgatctgtcgtccgcaaagcgcgagatcgtcgatcattcgggcgcgaaaaacattctgtccatccgcaacctctgggtcgatatgccgggcgaaaccgtgcgtaatgtgacgctggacgtgaaggaaggcgagatcctcggtatcggcggtctggccggtcagggcaagctcggcattccgaacggcgtgatgggcctttatgaagcgggcggcacggtcgagtttgacgggaaggaaattcccctcaacagcccgagaaagtgcctcgacgcatcgctggccttcgtctctgaggaccggcgcggcgtgggtctgctgttagacgagacgctggagtggaacgttgcgttccccgccatgcagatccagaacaaattcctcaaaaaaatcggccccgtcacctggcgtgatgaaaaggccatccatgatataacccagaagtacataggtgaactgatgatcaagtgcaccagctcgctgcaaaaggcaagagagctttccggcggcaaccagcagaagatttgtctggccaaggcgttcgcgctggagcccagattcctgttcgtttccgagcccacccgcggcatcgacgtcggcgcgaaggcgctggtgctcgacgcgctcaagcgcttcaaccgcgaaaacggcgtcaccgttgtgatgatctcctcggagctcgaagaactcagacagacctgcgacaggatcgccatcgtttcgggtggtcgcattgccggcattttgcccgcaaccgattcctccgaggcctttggtgctttgatggtcagtcaggtgaaataa

SEQ ID NO: 2326 - DNA, 1428 bp, Unknown
  Artificiall/Consensus sequence
caaatcgccataatacgcgatcacatcgccggggcgcagaagctctgcaagctttttcccaagcagttccgtctgctcgggagacttcgttataacggtcataactgcatctcatttcatctgtcagtttttcgcaccctatcttaccatacccgcccgaaaattgcaaagaaaaagctgttttccgccctccaaaactttcggtttacagacggcgcagaatttgctataatgacttgtaacgattttgtagctttttgcagggaggtgacgcgattgcgtgaaatattccgggccatccgggagtttgtcagaaaagcggatatggttcttctcgcgctgtgcgtcacagcgacggtcttcggcatcgtggtcatctccagcgccacaaattatatcggaaacgcccggtatatccgcacacagacgctcgcgctcattctcggcatcattgtttacgtccttctgacgctcattgacgtcgatatcatcgcagagcggcgagagctgctgctgattttcagcgtgctgtttatcggcatgctgaaaatctggggctccgagcgcggcggcaacaagagctggcttgattttccgttcctgccctttaacatccagcccgccgagatctgcaagatcttctatattctgattctggccaaggtcatcagcgtcgaggaaaacaaaatttcatcgcccctgaccgtcatgaagcttgcaggcattacgatgcttctggcaggcgaaattatccttgtctccgacgacctcggcgttgcgctgtgctatgtcttcattttcatcatcatggcctatgtcggcggcgtgaacttcatgtggttcctcgccggtctcggcgcggtcgcggtcgcatccccgttcctctggagccgcatgcgagacgaccagcgcaaccgaatcctcgtcattttcgaccagaccatcgaccccaaggcgcagggcgtgcgttaccagatgaaccgaagcatccgcgcgctccagaacggcggtattaccggtcaggggctctatcacggcagcatgattcaaagcaactctctgcccgagcagcacaacgacctcattttctcgtccatcggcgaagagctcggactcttgggctgtctcgcggtgctgattttgctgacggccattattatccgcatcatccacgtcggcatccgctccggcaacaacatgaaccggctcatctgcgtcggtatcgcgggcatgctcgcctcgcagacgatcatcaatgtcggcgtgtgcctcggcattttccccgtcgtcggtcttactctcccgtttttcagctacggcggcagctcgatcgtcacgatgttccttgccatggacattgtctccggtatccacatgcggccggcgcccgatatcagcgccatgtatatcaggccaaaactcaattag

SEQ ID NO: 2327 - DNA, 2769 bp, Unknown
  Artificiall/Consensus sequence
aggagcaagaccatgaaacaatatcccggctacaccctcgtcaagcgcgaggactgccccgaacagcacggaacgctgaccgtgctgacccatgacgtcagcggggcggctgtcctgctggtggaaaacgacgacgacaacaaggccttcggcatcggcttcggcacctttccctccgacgacaccggcgtgttccacatcctcgagcactcggtgctggcaggcagcgagaaatacccggtgaagtcgccgtttttgcagctgctcaagagcagcatggcctccttcctgaatgccatgaccttcccggacaagacggtgtatcccttcgctacccccaacgagacggatttcaagaacctgatggacgtctatctcaacgcggtgttctgcccgctggccatggtggacaagggcgtattcgagcaggagggctggcaccgggacgaagacggcacggtgagcggcgtcgtctacaacgagatgcagggggcgctggcgacgccggacgcacagctgcagaacgctctgagccgggcaatgttcccggatacggcttacggcttcgtctccggcggcgacccggcgtccattccggcgctgacctatgagaagtatgtgcgggtctaccgccgccactacagtgccgacaactgctgcatcaccctctacggcaagatggacatggctgagaagctggccttcctcgacgagcagtatctgagccgtatgcccaagagcgccagccgcccccgcctgacagtgcaggacgagcaggtcggtgcgaagcggaatatcccgtactataccgagaagccggagccggacgaggctcagtgtgcgctggcgtggtacaccggtgcgttcagcgaccgggagcgccagctgggcgtggagatcttgctggacgccctgctggggacgaaccaggcgcctctgaaagccgccctgctggaagaaaaactgggcgcggacatcgacgtgggcttcgatgacagcacgctgcagccgaccttggagcttgtgctccggggcgcgacggaagagtcggcgggcaaatttgccgccgccgtgcgcaaggccgtggacggcatcctcgagaagggcatccccgaggagctgctgatggcaagcctcaactccaccgaattcgcttcccttgagcggccgggcagtatcccggacggtgtgctggacgccatcaatgcatctacaggctggctccacaccggcgacccggccctgctgcttcacacgaacgctctgttcgcttccctgcgggagaagctggaacagggctggttcaatgagctgctgcgggagctgttcgcgcctgcgccggtggagatcatccaggtgccgaccctgcccaagaaagaggaagaggggcgcgccgcccgcaccgacggcaagctggtgctggaccatccgctgacagccgccgacctcggcgagggcaaaaagcagacaccgggcagcaaggagctgctggcgggtgcagaactgctgcaccacccctcggcaggcaatacctacctgtacctttactatgatctgggcggcatggcaccggaagatatgtcctgcctgcatctgctcacggatgtcattgatgagctggacaccgaaaagcacacggcccaggaactgaacactctgcggaacacctggctgggaagcagtggtgcgtggatggactgctggacgggacggcaggaaggcaggccctgccacgcaaagctcatcgtggggatgagtatgctggaacgcagcctcgaaaaggctgtggagctgggcagtgagtggctgtatgagacaaagttcagcggcccgcaggccgaagctgctatggagcgggtggcaagccagcagaagctgctcatggagcagaagttcctgcgggagggccacgccttcgccgccatgcgggcggcggcacatttctcggtggaatccgcactgagtgagcgctgcaacggcgtgagctactaccactatctctgtgagctgctggaaaaggccgactggaccgctctgggcaaaaagatggaagagctgtggaagagtgtgctgaaaaagaacgccctgaccgtcagcctccacggcagcgacgcggcgctggataccctgaaaaagcttctgccgggcagtgccttcgcggcagaaaagcgcggcgaggcaaagccctacactgaggagctgacagctccggtgaacgaggcattcatcatcgacggcggcgtgaactacgatgtgctggtttggcccatggagcggcggttggagcggaaggtgctggcccgggtgatgagctacgagtatctgtggcacaacatccgcgaggtgggcggcgcgtatggcaccggcatggtgacccagaacgacggcaccgaatatctctacacctaccgcgacccgcacctgaaagaaagctatgagactttcgcaaaggggccgacagaactggcaggccgcgactacaccgagaaggacatgaacgagttcatcgtgggcgcggcagcaaagctggataccccgcgcaagccccgggaagaggctgcgtctaccgactgcaaatatttctgcggcatcaccgacgagatgactgccgccgagcgcaagagcctgtgcagtgtggatgctgccgccctcaaggccgaggcggcggacctgtcggcccggatggagaagggcgtgagggtggtcttcggcagcaaggaggctgtggaggccgcaaaggagctgtttgaccgggtggaaaccctgtaa

SEQ ID NO: 2328 - DNA, 1893 bp, Unknown
  Artificiall/Consensus sequence
ttgctggaagataaaacaactgaaacgcggcaggacgagccagccggtgcgccgcggcacaccggcttccgcgcaaagctgcgctcgctttgggcgcagctccagtgcgtccatctgctgcgccgccaccggcggtatcgccgtcgccgccaccggctggacaatgcctcccggaagctgcgctcgtcgaagctggtattgcgcattggcgcagcgctctacgcgctgggctttggcgcggagtatgttgccgtgcgggtgggacgtgccgtcaagtacgccgctctctgggttgctggaggcatccgccgctttgcaaaggctctggcggagacggcgttccccggcgcagcacaggtggccaaagacctgtttggccccatcgtgctgtttgcaaagggcatcgtgtcccttctcatccatgcccaccgcatccgcagggagcagggcttcggggcagcatttgaggccagcgtccactacttcaaaaacggcgtccgccgcaacctcagtctgctgccccgcatggcgatgtatgccctgcccatctgcgcattggcgctgggcgcagcagtgttccaatatgtcatccaccagccttatgcactggccgtccgggtcaacggcgaaaccgtgggctatgtggcgaatgaggacgtcttcaacacggcccgcgaggacgtgatggagcgtatcagctacgccggcaccgacaagaccgagtggaccatcgagccgagctacaccctcgccatcgcccaccacatgatggacgaaaacgagatggcaaacgccatcattcagagcgctggcgaccagatcagcgaaggcacggctctttatctggacggcgagttgacggcggtgtgcagcgacggcaacgcgctgcgggattacctcgccgccatgctcgacccctacgaggaagaagaggacgaccccaatgtgagcgtgggcttcaacaagcaggtcacgctggaagacggcctctacttcaaggaaggcttgcaggattttgagaccgtccggcaggagctggtgggcgtgaagcaggctcagaaggtctacaccgtcaaggcgggcgacaccctctggtccatcgcacataacaatgacctgaccttccgtgagctgtgcgccctcaacccggcgttcaagggtgagccgctgagcgagacgtccagcatccttgagggcgaccacctcgtcatcaccaaagaagaggctggccttgaggtgcgcatcacccgcatcgagacccgtgaggaagaaatcgcattctctacggagacgacaaaatccaacgaatatacgaagggaaccaccaaggtgctccaggagggcgagaacggtctgcgccgtgtgaccctccagaacgtctacgacaccaagaatatccttgtggaccagagcgtgctttccaccgaggtcatcaaggagccggtgaacaagaaggtggtcgaaggcaccaagaaggtgacttccagcaccaagtacatcaccggcagcggccagttcatctggcctgtgccgaactaccgctactgctcgcgctggtacggcggacgccacaggggcgtggacatctgcgccccggccggtacgcccatctacgcctccgcaggcggcaccgtcaccaaggcgggctacaacaaggccggtgcaggtacgggctacggctactcggtcatcatcaaccacggcggcggatacagctctgtgtatgcacactgcctgtccctgactgtcagtgcgggccagaccgtccggcagggccagctcatcggctatttgggcagcacgggccgttccaccggcaaccactgccactttgagatacgtcttaatggttcgtacattcccccacagaacgtattcccggggaagaaataa

SEQ ID NO: 2329 - DNA, 1518 bp, Unknown
  Artificiall/Consensus sequence
atgcgcaaaagtgtttccgttgcgttcttctcgctcatgagcaccctgctcatctttggcacggtgatcatgggcggctcggagctggtgctgttcagcaactacttcgcgcaggagcggtacgacgtgctggacgaagtggtcaatgtggcccagcgcacggcgtcccatctggtgcaggaagccgctctgccggaaggcgaagaactggaagccctgaacaccaagctcgagctcatcggcgagagcgcggaagtgtacctgttcttcaccgactgcgacggcaacgtggtgctggcctcagacccggacgatctggccggggatgtggtagaggcgtccgtgctggaaaagtcggccaaggccaaggagaattatcacatcttcggtacgctggacggcgtactgaccgagaaaagctacatctcggtgcatgagatgcgcagcgagagcggcgagtgtaccggctaccttttcctctgctcgtcgggcgaccggctggtggagttccgcaaggagttcttctcgaacttcttcctctcggcctgtctgatgctgctggtggccagcgtcctcaccaaggtgatgatgcataagctcaccgaccccatccagaaggtgacggatgcggcccagcgcttcggcggcggcgacctgtccgtccgggtcgagggcgtggacggcgaaggcgaagtggccgacctggcccgcaccttcaacaagatggcggacaatatccagtccaacgacaactcccggggccagttcatgggcaatattgcccacgagctgcgcacccccatgaccaccatcaagggcttcatcgacggcattctggacggcaccatcccgcccgatatgcagaaccactacttacagctggtcagtgaggagacgggccgtctggcgcgcctcatccagaatatgctggacctctcgaagctggagagcggcgaatatcaggtgaacgcccggatgttcaacatctgggagacgctgactggcgtggccctctcggcggagcagcgcatcaacgacggcatgatagacattgacggcctgaccatggatgagaaggtgctggtctatgccgaccccgacctcatccatcaggtggcctacaatctgctggacaacgccatcaagttcaccccggcaggcggcaccatccgcttcggggtggagaggctgggcccggaggtggaagtctccatctggaactccggccagggcattagccccgaggcgctgccctacgtcttccagcgcttctacaaagaagaccagtcccggggtctccacgcccggggcgcaggtctcggcctgaacatctgcaaggtgctggtcaacctctccggcggccagatacgggtggagagcaagcagggcgagtggtgcaggttcgtcttcaccctgcccgtccagccccccaaccccggcggcatgaagcgtctgcccgacgagagcggccgccccggtgcggtggaagacccggccagcatgaagccggtagactaa

SEQ ID NO: 2330 - DNA, 2115 bp, Unknown
  Artificiall/Consensus sequence
atgaggatttatatacaggagaagaacgtaatggcaaaactcgtcatcgtggagtcgcctgccaaggcgaagaccatcggcaaatatctgggcaaagactacgaagttacggccagcatgggccacatccgcgatctgcccgcctcccagctgggcatcgacatcgagcatgactatgcgccgcaatacatcagcatcaaaggcaaggaaaagctcatcaaagagctgaagagcaaggccaagcactccgacggtgtgctgctggcgaccgacccggaccgtgaaggcgaagccatcagctggcatctggccaacatcctgggcctcgacccccacgagcccaaccgcgtgaccttcgatgagatcaccaagaagggcgtgaaggagggtatggcccacccccgcgccatcaacgaagacctcttcaacgcccagcaggcccgccgtgtgctggatcgtctggtgggctataagctgagccccttcctgtggcggaaagtccggcgcggtctgtcggcgggccgcgtccagagcgtggccgtccgcatcatcgacgaccgcgagaaggagatcgaagccttcaagcccgaggaatactggaacgtggacgccaccctgggcgtgggccggaagagctttacggcccgtctggcctccgacgacaagggaaaaaagctcctgccgcactctgaggccgaggcccgcgccatcgaaaagggcctcgagggggccgagtacaccgtgggcgaactgaaaaagggcaagcgcgcgaagcagcccaccccggccttcatcaccagtaccctgcagcaggaggcatcccgccgtctgggctttacggccacccgcaccatgcgggctgcccagacgctgtacgaaggcgtggacatcgccggccacggcaccatgggcctcatcacctatatgcgtaccgacagcctccgcatctccgacgaggctgtggcagctgccagagagtacatcgccggggcctacggcgagagctatatctgcccctacaagcgcacttggaagaccaagagcgccacggcagcgcaggacgcccatgaggccatccgtccctctgtgccgggcctgacccccgacgaggtggacaagagcatcagcggcgataccgccaagctctaccggatgatctggagccgcttcatggccagccagatggcggactgccagcaggacaccgtgtccgtcaccgtctatgccggcggctaccgcttcaaggccagcggctacacggtcactttcgacggtttcaccgccctgtacgaagaggccaccgacgagaaggaaaagaaggagaccagccttcctcccctcgaggagggtcaggtgctcaagctgcgggagctgaagagcgagcagaagttcacccagccccccgcccgctacaccgaagccaccctcatcaaggcgctggaggagaacggcatcggccgcccctccacctacgcccccatcatcaccaccatcatcgaccgcggctatgtggagcgggagcagaagaagctcaagcccaccctgctgggccgggccgtggacggcctgatgctggagcagttcccccacatcgtggacgtggacttctcggcagagatggagaagaacctcgataaggtcgagagcggcaagacggactggcacaagaccgtggacgacttctacaagggcttcgccgccagcctcgagcaggccgagaagaacatggaaggcaagaaggtcaaggtgccggacgagccgtccagcgaggtctgcgacctctgcggccgtcccatggtcatcaaggtgggcaagtacggcaagttcctggcctgcagcggcttccccgagtgccgcggcaccaagcgcctcgtgaaggacaccggcggcatctgccccaagtgcggcaagggccgtatgctggagcgcaagagcgccaagggccgcatctactacggctgtgagcgctaccccgactgcgacttcatgacctgggatatgccggtggccgtcaagtgcgagaagtgcggctccactctgttccgcaagggctccaagctctactgcgcaaaagagggctgtgactttgagatgccggtgccgaagaaagactga

SEQ ID NO: 2331 - DNA, 3240 bp, Unknown
  Artificiall/Consensus sequence
atgcttcagcttatcaatatcgaaaagaaatacaccaccggcgatctgacacaggcagcgctcaacggggtcagcctcaacctgcgcgacagcgaattcgtcgccgtcctcggccccagcggctcgggcaagaccacgctgctcaacatcatcggcggcctcgaccgctacgacaacggcgagctcatcatcaacggcatctccacccgccgctacaccgaccgggactgggactcctaccgcaaccacaccgtcggcttcgtgttccagagctataacctcatcccccaccagaccgtcctcgccaacgtcgaactggccctgaccatctcgggcgtgtcgggcgctgagcgccgccgccgtgccgccgaggcgctgcggcaggtgggcctcggggaccagctccacaagcgccccaccgagatgtcgggcggccagatgcagcgcgtggccatcgcccgcgccctcgtcaacaaccccgacatcctgctggccgacgagcccaccggcgcactggacagcgagacgagcatccaggtcatggagttgctgaaggatgtggcaaaagaccgccttgtggtcatggtcactcacaaccccgaactggcggagcagtatgccaaccgcatcgtccgcctgcgggacggcgccatcaccgacgatacccgccccttcgagccggacgacacaaagcttgcccctcccatccacaagaacatgggccgttcgtccatgtcgtggctcacctcgctggccctgagcttcaacaacctgcgcaccaaaaaggcccgcaccctgctcacggccttcgcgggcagcatcggcatcatcggcatcgcccttatcatctcgctgtccaccggcgtcaatgcctacattgccgacatggagcgctccaccctgagcgaatacccgctgcagatcctgagcagcggcgtggacatcacgagctttttgtcctcgggcagcagcgacggcaccacagccaccggcctgcccaccgacgaggacggcaaaaaggacacctccggcggcgtggagggaatggtctcggtccgccagctcatcaccaagatggtgtcgggcctgacgtccaacgacctcacttccttaaagaaatatctcgacagcgacgagtccaccattgcggatgacgccacctccatcgagtattcctacagcgtctcgccccagatctaccggcaggacgccgacggcagtgtgcatcaggtcaacccggactccaccctctcgatgctgggtctgggaagctcgggttccggctccacctccgtcaccagcagcctgatgaacagcgtgggcagcaacaccagcgttttctatcagctgcccgccaacagcgacctttataagtcccagtacgaagtcaaggccggccgctggcccgaaaagcccaccgaatgtgtcgtcgtgctgagcaaatacggcaccgtgaccgactacgccctctactccatgggtctgcgggactccgccgagctggacaagatgatacagcagttcgcccagaaccagaacgtcgatgtccccagcgatttccgcacctacagctacgacgaactgatgggcctgaagttcaagctggtgaacagcgccgacacctacgtctacgacgacacctacggcatctggaaaagcaaggccgacgacaaggactatatgcagcagctggtggagaacggcgaggacatcaccatcgtgggcatcgtccagccggactacaccgcctccgcttccatgctcacctccggcatcgcctaccccgcctccctgaccgagaaggtcatggaggacgctgccgacagcgacatcgtgaagcagcagatggccgaccccgccaccaacgtcctcaccggcgagagcttcggcaaggccgagagcctccgcgacttcgatttgaccagcctcttctccatcgacaccaacgccctcaagaatgccttttcttttgatgccaacgccctcgacttcgatttgaacggtgccttcgatctcagcagcggcagtttcgatttgagcagcctcatcgacttctcagatctcaccctcgacatcggcgagctgcccgacatcgacctcagcgatgcctttgcagagctggacctctccgtctcgccggaggccctgcagaacctcgtgcagaaggtgttcaaggactataagaaatatatcatcggcaacggcatcctcaacttcaagaagtggagcttttctgcctacctcaagtcggagcagttccagaagctgatggccgagtccatgaaagacctcgttgacccggacaagctgcagggccagctctcgagcgctctgcagaccaccatccagaccgtgatggagacctactccgaccagatcacagaggtgctgaaaagccagctggacgctgccatccagaagggcatcgtcaccttccaggaccagatacagtcccagctcaagacggccatccagcagaacatcggcaagctgagcagccagatggagagcgccatcaagatcgacgcgtcggctttccagaaggccatccagctcaacatgaccacctccgaactgaccgagctgatgcgctccaccctccgctcctcttccgccacctatgaggccaacctgacggccttcggctacgcggacgaggccgcccccagccagatcaagatctatccgaaggacttcgccagcaaggccaccatcctggaaaagctggatgcctacaacgccgggatgtctgcaaagggtgaagacgaaaaaatggtgcagtacaccgacctcgtgggtaccctgatgaccagcgtgaccgagatcgtgaacatgataagcagcatgatggtggccttcgtctccatctcgctggcagtctcctccatcatgatcggcgtcatcacctatatcagcgtcctcgagcgccggaaggagatcggcatcctgcgcgccatcggcgcttccaagcggaacgtctccgaggtgttcaacgcagagaccttcatcatcggtctctgctcgggcgtcatgggcatcgtcctcagcgagatactgctcatccccggaaacatcatcatccagaaagtctccggcacttcgaccctcgttgcttccctgcccgtagacgcagccctcttcctcgtggcactggctaccctgctcaccattctggccggcatcatcccggcccgcggcgcagccaagtgcaaccccgtcaaagccctgcgcgccgagtaa

SEQ ID NO: 2332 - DNA, 1617 bp, Unknown
  Artificiall/Consensus sequence
atgaaaaaagaagaacttcagcagaacatgaaagacaggatgcagcagttcgaggacggcggcctccggctcctgaaaaagggtcagaaaggcatcgtccacgcgattttcagccgcttcgggctggtgctgctgctcatgctgttgcaggtcggtgtactgtggagcgtgttccagtggttcggcggactgctgcctcattacttcggcggcagtgtggccatgtcggccttcatggtggtctacatcctcaacagcgagatggacaacagtgccaaaatcacatggatggtcactatcgccatcctgccggtcgtgggtgtgccgctgtttttctacgtcaagagcaacatcggccacaacgccctgaaaaagcgggtgacccacctcactgaggaggcccggggcttacagccccagccgctggctgcggcccaggagctggccgaagccgaccccggcgcggcctcgctggcgcggtatctccacggaaagggcggcggcttctcggtctacaggaacacagaagttacctacttccccggcggcgaggccaagttcgaagagctgctgcgccaactggaaaaggccgagaagtacatcttcctcgagtactttatcatcgacgagggcctcatgtggggcaagatcctcgaagtgctggcccgcaaggccgctgagggcgtggacgtccgggtgatgtacgatggcacctgtgagttcaccaccctgccccgggattaccccagccgcctcgaaaagctgggcatccagtgccgggtgttctcgccggtgcagccctttgtctcgacccattataattaccgcgaccaccggaaaattctcgtcattgacggcaaggtgggttttaccggcggcgtgaacctcgccgacgagtacatcaaccacatcgagaagtatggccgctggaaggacgccgccgtcatgctggaaggcgaggctgtccgaccgctgaccatcctcttcctcgagatgtggagcatcctccgggagccggagtttgagaagttcctctccgtgccgccccactccgtcccggcgaaggggttcgcggccccttacggcgactgcccgctggacggtgagcgggtgggagagatggtctatatcgacctgctcaaccgcgccaagcgctacatccacatcatgacgccctacctcatcctcgacggcgagctggaaacggcccttaagttcgcggcagagcggggcgtggacgtccacctcatcctgccccatgtgccggataagaagttcgcctatgcgctggcgaagacgcactacaagtctctgctggactcgggcgtgaagatcagcgagtggctgcccggctttgtccacgcgaaggtctttgtggtagacgacagcgaggccgtggtgggtaccataaacctcgactaccgcagcctctaccaccacttcgagaatgcggtctggatgaaggataccgcctgcatccccgccatcgagaaggatttccagaagacgctggaattctgccgcgacgtcgagcccacccgggagagcatctgggagggcaaagtgctgctccatctggcaggaattttactgaaagttattgcaccattgctgtaa

SEQ ID NO: 2333 - DNA, 1125 bp, Unknown
  Artificiall/Consensus sequence
atactgattttattattcgtcaggaaggtatctgtttctatgcttttcaccatcaacgatctcggcttttccatcgccggactgctgctggaaggctggctggcctttgcagcccggtgcgtctgtgcgctggccctgctgttcatcggctgggtcgtcagccgctggctgcaaaaaagcctcttcccccgcctgctgaagcgcagctggcactttgcctttacgcaccccctgctggaaagctttgcccgcccggcggcccgcatcgcgtggtacaccggcatgtatctggccctgcgcagcctgccctgggccatccccggccttgcggccctgctgctcaaagcctatcggatgatgctggtcttcctcatcggcaccggcttctaccacgcttccggcatcgcggctctgctgctggcctcgtccagcgaagaagtccgcaccaaccgcaccctgctcaccctgctggataaagtctacaaagtagccgtcgtggtgctctgcggcgcgaccatcgcacaggaaagcggcctgcccgtgggcagcgtcgtggccagtgccggtcttatcggccttacgatctctctggccgcacaggatatggccaagaatttcttcagcggcgtggtcatcctgctggacaagcccttctccatcggtgactggatcaccgtcggcgacgtggagggcgaagtggtggacatcaacttccgctccacgaaagtccgggccgtggataactccatctacatcctcaccaacagcaccgtcagcagtgccaccatcaacaacgctaccctccgcaacaagcggctctaccgcttcacgctgggcgttacctacgacaccacccgaccccagctggaaaagctgatggccgacctcgacgccatgctcaaggccagccccgatacctacgaggacaccgcctttgtccggatgaccggcttcggcgactcgagcatcaacctgatggtctctgcctatctgcgcaccgccgacctcggcgtgtttttgcggatgcagaacgatttgaacctcaacatcatggacgtgatgaaggccgacggcgtggatttcgcatttccctccacgacagtctacctcgcaaaagagaactga

SEQ ID NO: 2334 - DNA, 2109 bp, Unknown
  Artificiall/Consensus sequence
atggctgcaagagatacaactaatcgtagttttgaaaaaggagggctatttgtggcagaggaaaaattccatctggtgtcgtcctacgcccccacgggcgaccagccgcaggccatcgcacagctggtagagggggtagagcggggcgaccgctgccagaccctgttgggcgtcaccggcagcggcaagaccttcacgatggcgaacgtcatcgcccagtgcaaccgcccgacgctggtgctggcccacaacaagacgctggccgcccagctctgcaccgagttccgctcgtttttcccggacaacgccgtggaatatttcgtctcctactacgactactaccagccggaggcctatatccccagcaccgatacctatatcgaaaaggacagcgccatcaacgacgagatagaccgcctgcgccactcggccacggcggcgctctcggagcggcgggacgtcatcatcgtcgcgtcggtgtcctgcatctactcgctgggcgaccccatcgactatcgcagcatggtcatcagcctgcggcccgggatgcagatggagcgggacgagctgtgcgaaaagctggtgacgctgcaatatgagcgcaacgatgtcaatttcatccgcaataagttccgcgtccacggcgacatcgtggacatctatctggcctatatgagcgagctggccatccgggtggagttcttcggcgatgagatcgaccgcatcaccgagttcaaccccctcacgggcaccaagcagaatgtggtcaagcatgttgccatcttcccggccagccactatatcgtcagcgccgacaaaaaggctgccgccattgaaaagattcgcgccgagtgcgacgcgcaggtgaagcagttcacctcggaaggcaagctcatcgaggcccagcgcatccagcagcggacgaactacgacattgagatgctgacggaagtgggtatctgcaagggcatcgagaactattctgccgttctgtcgggccgtgcgccgggcagtatgcccacgactctgcttgactatttcccggacgacttcctgctcttcatagacgagagccatgtcaccctgccgcaggtgcgggccatgtacggtggcgactacgcccgcaaaaagacgctggtggagtacggtttccgcctgccgtcggcctttgacaaccgccccctcaagttcgaggaagtggaatccaagctcaaccagatgatattcgtctcggccacccccggcgagtacgagcggaagaacagcacccaggtggcccagcaggtcatccggcccacgggtctgctggacccgctcatctcggtgcgccccgtagaggggcaggtgaccgaccttctgggcgagataaacgcccgcatcgagcggcatgagcgcgtcctggtcacgacgctgaccaagaaaatggccgaagatctgacggattactttaccgaacaggggataaaggtcaagtatatgcaccacgaggtggacaccttcgagcggatggagatcatcaaagacctccgcctcggcaccatcgacgtggtggtgggcatcaacttgctgcgtgagggcctcgacttgcctgaggtcagccttgtggccatcctcgacgccgacaaagagggcttcctccgcagcgagacgagcctcattcagaccatcggccgcgccgcccgcaacgccgaaggtctggtcatcatgtacgccgacgaggtaacggacagcatggaccgtgccatcaccgagacagagcgccgccgcgccatccagatggcctacaacgctgaacacggcatcgtcccgaagaccatcgtcaaggccatcccggattcgattgagatcagcgacaaggctgagaatgccaggatgaacacccggcggatgggcaagctcgagcgcgaagccgccattgaccgcctgacccgggagatgaaggaagctgccaagctgctggaatttgagcatgcggccttcctgcgcgaccagatcgaccgcctgcgccggggcgagaaccccaccgtggattcctcggcagagacggagcggaagcagaaccatgcacagacacagagaagagggagaaagtaccttggcaaacgataa

SEQ ID NO: 2335 - DNA, 1611 bp, Unknown
  Artificiall/Consensus sequence
ggagctttcgctctgacggcggacaggccggataaggcggaagatgcgcggcagaatatcacagagaaggaggatgggtgcgtggggcgcaggatgaccctgaaagggcagatcagtctttgcctggcagcgttttttctggcactggcggggcagatattcttgagcttttaccagtctggcaccgtgttgcgggaactggacgaccagatgggcaacttcaacgccatcagccgcttccagaacggtgtggagcggagcctttcggccatggaagattaccgctgggagtacggcgacgccaaagcgctgacagaggagctccacagcgccttttccgtcaccaacgcatggctctggcgcatcgagagcgaccttggcactgtgagtgaagagcagtatctgctctacaatgccgtttccactacctacgacagctacaccgcactggtggaccagctggaagaagcggtggccgccggtcaggacacgaaagccgcccagctctactataataaaatcgtaccctgcggcggctatctgcgccagtatacccagcagctgctgaacacggccatcaccgacgctcaggggacttacaccaccgtgtcggccctcagcgaccgggtgaaatgggtgcagaccgtcgtggtggcgctctgccttgcgctgggctgcgtcatggccttctcggtgctgacgctgctgaccccggtgcagcagatgatcggcgcctcccgggaggtcacccggggcgagttcgactcgcccgacctgcctgcgccccgtcagccggaaatggcccagctgaccgaagccttcaaccacatgaagcattcgatggcggagcaggtgaccaccctgcgggagaaaaacgagatggagcgggagctccaccgccagaagacggaagctctggaattacagaaccggatggagcgcagccgtttgcagcagctgcgcagccagatagacccccatttccttttcaacaccctgaacgtcattttacagaccgccggacaggaaaaagcctaccgcactcaggccctcatcacggctctgtcgcacctgctgcgctacagcctgatgagcaacgacgagcaggtgccgctggcccgggaagtgcgcatcgtggacgagtattactccatttatcacgtccgcttcggcgaccgggtgaagatggtgtggcgcatctccgactccctcgatttgacggagacgatggtgccgtccttcatcttgcagcccatcgtggagaatgccttcaagcacggcatctcgcccaaggaagagggcggcgtggtgcgtatccgcatcaacccgctgcgggataaggggctgctctatatcagcgtctgtgacaacggcgtgggcatccagcccgaacagctggcccagctgaaagccgcgctggcccagcccggggagcgctgggagcatatcggcgtctataacgtggccgcacggctgcggcttctggataaacgggggcggctggtcatccgctctcacccgggccgggggacggccatcagtatgtacctgccccttgtagaacttttggaggaggatttggacgatgatacgcctgttgatcgcggatga

SEQ ID NO: 2336 - DNA, 2085 bp, Unknown
  Artificiall/Consensus sequence
atgaaaaaattagcgagggccatcgtgaagatgcgcaggctcatcctcatcgcggcggtcctgctgctcatcccggcggcagtgggagccatcgccacgcccatcaactatgacatcctttcttacctgcctcaggatctggactcccgtgtgggccagctgctgctggaaacggattaccatctggcgtccaccaacatgataaccgtggaggggatgcccaccaacgagctgctggccatgaaggccgagatcgacgaggtgccggacgtgctgaacaccttctggctcagcgacgtgctggacccggcggtgccgacggagatgctgccggcggatgtccagcagtttatgttcggcaagaacgactccaccatcctcatcgtccagctgggcggttcgagcgtcagcgaagagacgatgcaggccgtggcccaaatcaagaagatactccggaaggactgcttcttcggcggcatcagcgtcatcctgagcgacaccaaagagctggtcatgggcgagatgccctggtatgtgctctgcgccgtaggcggctgtctgctggtgctgttcctctcgctggaaagctggctcacgccgtttttgttcatgctggggctgctcttcccgctggtctataactttggcacgaatattttcctcggtcaggtctgctttatcaccgcgtcgctggcggcggtcttgcagctgggcgtgacgatggatttctccatcttcctgctccaccgctacgacgaggaaaagaagctctgtgcctccaacgaagaggccatggagaacgccatctgtaagaccatgagctccatcacggcgtccagtctgacgaccattgcgggctttctggccctctgtgccatgcagctgacgctgggcgcagacctcggcatcgtcatggcaaagggcgtggcgctgggcgtcatctgcaccatcgtcatcctgccctcgctcattctcttcttcgataagtgggtggaaaaatactgccaccgcacctttatgcccaagctcacccacctgagccattttgtctcgaagcacccgatgcccgtcgtggtggtgtttatcctgctgatgatccccttcgggctggcccagagcaagaccgatatttactacaacatttttgccgctcttccgcaggatatgcccggcatcgtgggtacgaacaagctgggcgaagacttcggtatgatgaccaaccacttcatcctcgtgcgggaggagctgaccgcttcccaggtgtccaccctctgcgatgagataaaggaggtggacggcatcacccaggtggtgagcctcgactccatcaccggcccgggctttgagacggaacttctgcccgacgagctgatgaacatcgtccagaacggcggttacaagctcatcctcgccaatggccgttataagtcgggcagcgacgcgctgaacgctcaggtggacgagctggtccgcctcgtcaaggaggcagaccccgagggcctcgtcaccggcgagggtgccatgatgaaagacctcgtggagatcgccgacgaggatttcaaaaatgtcaacatctggtccatcgcggcggtgctggtcatcatcgcgctgtccttccgcagcctgtcggtgccggtgctgctggtggccagcatcgaagcggccattgccatcaacatgggcatcccgtactttatcgacgactcgctgcccttcatcgccagcatcgtcatcggcaccatccagctgggcgcgactgtggactactccatcctcatgaccacccgctaccgcgaagagcggctggccctccgctcgcccaaggcggcggcacagcaggccctcgagcactgcagccagagcatcctgacaagcggcctgaccttcttcgcggccactttcggcgtcgcggccatcagcaaggtggaactgctggaaagtatctgtatgctcatctcccgcggtgcgctcatcagtatggtggttatcctgctggtgctgcccgccggcctgatgctgctggacggcctcatctgccgcaccacctaccactggctcaacgcccccaacgctgcaaaggagtga

SEQ ID NO: 2337 - DNA, 1371 bp, Unknown
  Artificiall/Consensus sequence
gcggaggagcgaatgacgagcacaaaatttgaaacgaagcctttgtttacccgccagcagctgacggccctgctgctgccgctcattgcggagcaggccctgagcgtgaccatcggcctggccgataccctcatggtgtcgtcggtgggcgaggcggcggtgtcgggcgtgagccttgtggacaccttcaacaccctgatgatacagatcatgacggcgctggccaccggcggcgcggtggtcgccagccagtacatcggccatcgggaggagaagagtgcccgggctgctgccgcacagatcatgttcatcatgtccagcttcagcattcttgtggcagcggtggtcgtggtgggacgccacgccatcctgcggggcatcttcggctccatcgacgccgacgtgatgaagtacgccgagacgtatttcctgctgtcggccctgagctaccctttcatcggcctgtataacgcaggcgcggccctcttccgggcgcagggcaacagtaagatcagcatgatgtccagcctcgtgatgaatgtcgtcaacatcggcggcaatgccatcctcatctttggcttcaagatgggcgtcatgggcgcggcgctggccagcctcgtctcccgcgcggtggcctgctgtgctgtcctcttcctgctccagaagccggattgtatgctccgcgtcaccggcctgtcggccctgaagccggacggaaagctcatccagcgcatcctgcgggtgggcatcccggcgggcatcgagaacgggatgttccaaatcggcaaactgtcggtggccagcctcaccagcaccctcggcaccgccgccatcgcggccaatgccgtggccaacaccaccagcaccttcctgaacatcccggccagcgccgtcggcatggcggtgctcacggtggtgggccagtgcctcggtgcaggcgagaaagagcaggctgtctggtatgcccgccgtctgctgctggtggcctactgcggtgcctgggtcatgaacctgtcggccttcttcttcgccgaccactgggcgctgtcctggttcagcctctcgccggaggcttcggccatggcgctggaagtcatgatgtggttcaacatcgtctccctcttcttctggccctccagcttcaccctgcccaacatcctccgcgccgccggcgacgccagcttcaccatgaccgtcagcatcgtgtccatgtgggtgttccgcgtgggcttctgctacctgtgggtcctgaagatgggcggcggactgctcagcatctggatggggatgtatctcgactgggcgttccgctccatctgctttacggtgcgttttgtccggggaaaatggctcgagcagaaggtcatctga

SEQ ID NO: 2338 - DNA, 1518 bp, Unknown
  Artificiall/Consensus sequence
aagccagtaaaaaatagaggagaaaatcttttggaaagcgaaaagacctccggcggcgataaatattcgaagctcgccggcaataccatcatctttgccatcagcagcttttcgtccaagctgctgacgctcatcgtccagccgttcctgacctacgcgatggccgagatttccgacctcggcctgtcgaagattttgagccagtacgccaacctgctcatcccctttgtgtcgatgggcatgtccaacgccatcatccgcttcggcctcgacaagggcaacagcgaaaagcaggtgttcaccaacggcctgctcaccatcctcggcggcttcggcatcctcgtgctctgctggccggtggcgcagtttttgcccgatatggcccagtacggcctgctcatttatatttatgtcctgatgagctgcctgcgcaccctctgcacccagttcgtgcgcagccgccagtggaacaagctggtggccgtggacggcgtgctctgcaccgtggcgaccatggccttttatgtgctctatctggtgggcttcaagtggggtgccaacggctatctgctggccatcatcagcggcgacctcgtgagcgtgctcttcctgatgttcaccggcaggctctgggatttcatcgagctgaagggcatcaacaagaccctctggaagcagatgctccacttctcgctgcccatgataccggcccagataagcttctggatcatcaacgcctccgatctgttctttgtgcgtgagatgtgcgacggcctcgacggccacagcggcgacgcatggagcggcctgctctccaccggctacttcctgcccaccatcctcacgacgctgggccttatcttctacgacgcatggcagctgtcggctgtcaccgaggaagaggggagagccaagttctttacccagatcttccgcacctattccagcgtgctgttctgctgtgcagcgggcatcatctggctctgccgcccggtcatgcacgtcatgaagtccaactactattacgcatggcacttcgtgccgttcctcgtgctggcgtctacctgcagctgcttcaatcagttcatgaacagcgtctatgtcgtgaataagaagtcccagcgcagcatggtcaccatgatggccggtgccatcagcaactgcctcatgaactacttcttcatcaagtggtggggtcctgtgggtgcgacctatgcgtccttcctcggcctcggtctggtgttcactctccgtgccatggacgcccacggcatgatcgggatgcatgtccacccgggccgtgtcctcgtcaacgccgccgcgctggtgttcgaggctttcgtgctgctggccgatacgccgctgtacggcctctggacgggcatcatcacggccctcatcatcctgtacaacttctccggtgtctgggccatggcccgcatcctgctgcctaaaatcctgggccgccggggcaaggcccttgtggctgtcgtggacggctgggcagccaaaaagtaa

SEQ ID NO: 2339 - DNA, 1317 bp, Unknown
  Artificiall/Consensus sequence
atgttgaaaatcaaaggatggctgcgggcggctgcgctgtgcgtggcgttctgcctgctgctgaccgggtgcagcatccccatgccggaagagacggtgcaggtggaggaactgctgcgtgcgccccgccttgcgggcgattacggcgcattgcagaccgccctgaacgactggctgggggagagcgcccagctgaaatatccgctgcagggcgacctgctgtcgccctttgtgttgcaggatttcgacggcgacggtgaacaggacgcagcggtgttctacaccacggccctcacctccaatgtatgcgttgctttcttacgcaagaacagcgggggtgcctggcaggtgagccagaccgtagagggcctggccgattcggtggacaatgtccggctggctcagcttcaggcgggcggcacggcccagctcgtcgtgggctatgcggcttcgcaggatgaccactacttggccgtttactcctatgagaacggtgaggtgtcggctatccttgagcaggcctatgagcagtacctcgtggaggacatcaccggcggcggcagcgaagaccttatcctgatgtccacgctggaagacagcggcgtccaaatcgagctgctgaccgtcgataaggacggaaggtttcagcaggtggccgttatggcactgtcgggcgataagttctcgggctgcgcctcggtggcggcgggcctcggcgcggacggaaagcactatctggtgctggacggctggacgggcatctcgggcaataatctggcctcggtgctgctgcggttcgacgatgagagccagcagatggtgccggcctcacaaatcaccagcgaggagctgtacaatgcctcactgcgcaatgtcccaagcctcgtgagccgcgatttggacggcgacggcaccgtggagataccgacccagcccgacgaagcgggtctgctgaacatgagccagagccgacggatggattttatcgtctggatggactacacggcgtcagcgccggaaaagagtttcggcctgctggatgaggagaccggctgctatatcgccctgcccatcgagtgggagggcaacctgatgctgacggacagcacggacgaggaagacgctgtggagctgcggacggtagacgagaacaagctggtacttaccctgcggctggcttcgtccagcgagaacgctgtgggatggacccgccttggtgtggtggcgtcccgccagatgcaggcaaagctcggcccggatgtgaccatagaggacccggattaccggctctcccggtcgctgtaccggctgaattag

SEQ ID NO: 2340 - DNA, 1401 bp, Unknown
  Artificiall/Consensus sequence
atgaaattcctgcatttttttgagggaggagacactatggccgcaccggcacagccgcagcagaaaaagaccctgctcatgaccgagggcagcatctggaaaagcatcctgctcttctcggtgccgctcatcctgggcaacctgctccagcagctttacaacaccgccgactccatcatcgtcggcaactttctgggcagcaacgctctggccgctgtgggttccagcggctcgcccatctacctgctcatcggtttcagtcagggcgtggccgtcggcgcaggcgtcgtcgtgagccagtacctcggcgcaaaagataaaaaggaaacgcgcatcgccgtccacacctcgctggccatcgcggtcatcctcggcctcatcctgacggtgggcggcatcgccgtcagccgcagcctgctgatctggatgaacacccccgaagaagtcctcggcgacgccgtgacttacatgaagctctacttcggcggtgtgctgttcagcgtcgtctacaacatggcagccggcatcctcaacgcggcgggcaactcccgccgctcggtcctctacctcgcctgcgcttccatcaccaacatcatcctcgacctggtgctcatcgccgggctgaagatgggtgtggcgggtgcggccatcgccaccgacatcagccagctggtctcctgtgtgctgagcctccgctttctgatgaaggtggacgccgactacaaggtggagctttccgccatccggcccgatcagcggatgacctcccgcatcatccgcatcggccttcccaccggcatccagaacatggtcatctctttctcgaacgtgctggtgcagtccagcgtcaacagctacggtgccgccgccatggcaggctttgcggcctatatgaagatcgacggcttcaacatcctgcccgtcaccagcttcagcatggcggcgacgaccttcgtgggccagaactatggcgcaggcaacctcaaacgagtgaagaatggcatgtgggtcacgctgggcatgggcgtgctctacaccctctgcaccggcacgctgctgctggcgttccagaatcccatcatgcacctgttcacctccgacgagacggtggtggccttcgggtgcagcgccatgcactacttctgccccttctacttcctgctggccatcctccacggcatggcgggcgcagtgcgcggcaccggccgcagcgtaccgccgatggtggtgctgctcatctcgctctgcctcttccgtgtggtgtggatccagttcgtcctccccttctttgcgggcatcgagggtgtgttcgtcctctacccggtgtcgtgggcgctgggtgccgtgctgatggccctctacgcatggaaaggcagctggatgacttacgagcattcctga

SEQ ID NO: 2341 - DNA, 1596 bp, Unknown
  Artificiall/Consensus sequence
acgacctctaccgtgacctcaacaattcgtgataacgagggaaagaatatgaacatcaaacgagccaaagaagagatcgagcataccgtcaaagcgtacctcgccaaagatgctctgggcgaatacgccatcccggccatccgccagcgccccatcctgctgatggggcctccgggcatcggcaagacccaggtcatggagcaggcggcgcgggagtgcggcgtggcgctggtggcctataccatcacccatcacacccgccagagcgccgtgggcctgcccttcatccgtcagcgcaactacggcggccaggacgtctctgtgacggagtacaccatgagcgagatcatcgccagtgtctacgccaagatggaggccaccggcctgaaagagggcatcctcttcatcgacgagatcaactgtgtctccgagacgctggcccccaccatgctgcagtttttgcagtgcaagaccttcggcaatcaggccgtgcctgcgggctgggtcatcgtggcggcaggcaacccgccggagtacaataaatccgtccgcgatttcgatattgtcaccctcgaccgcgtccgccggatggacattgagccggatctgccggtctggaaggactacgcccgtgcagcccacatccacagtgctatcctgagctatctcgaactgcacccccagaacttctaccagataaacgccgacgtggacggcacccagttcgtcaccgcccgcggttgggaagacctctccaacctgctcaatacctatgagtcgctgggcctgcaggccgatgaagagctcatccgccagtatatccagcaccagaagatcgccgaggacttctcggcctacctcgacctctactacaagtaccgtgacgactacggcgtggaggacattctggccggtcaggccaagcctgccgcttttgcgcggctgctgcaggcccccttcgacgagaagctgagcctcgtgaaccttatcctgtccggcctcgagacgcgcttctctgcctcccggcgggcagacgctgtggccgacagctgctatgccttcctgcgggagacgaagaaagcctttgccgagatgcccgcagagctggcacaggagccgaactgctgggcgcagctctttggccagatgaccgccgattacgaggccgagacccagaaaaagcggaccgccggtctgctggataagcccacgctggaagcccgcttgcagaccgccaagaccctgcgcggctgggagaaagaacttctgcgcgctgccgcaccggacgcggacgccgctttcaaggtgctgcgcacccaattcggcaccctgtcggatgcccgggacaccgcccagcagacggccagcgccgcgctggaagcggccttcgactttatggagcaggcattcgccgagagtcaggagatggtggtcttcgtcaccgagctgaccctctcgcccgccgcccatgcgttcattgccgaaaacggctgtgagcggtatttccagtacaacaaagacctcctgctcgaccaccgcaaggcggccctgaatcaggagctggaagccgaacagcgtcggcacgggatgctgtaa

SEQ ID NO: 2342 - DNA, 2151 bp, Unknown
  Artificiall/Consensus sequence
atgtgggacggtctcttttcttttttgatttgttcgttgtatccaactgtttgtgagagatgcacaaatatatcagcttcgatttgtgagggcaaaaccgaatatccacaccattcgaccgattatcgcaacggtcttgcgaaagaaaaagtctttgataaaataatagcgaaagacagaaaaacgaccgcacaacagagaaaacgctacagatacacgggaggaaaacgaatgcgaagcatcgccaagctcatgcaggactggcagttcaccgggccggacggcaagaccactctggtggagctgccccacacttggaacgcaaaagacggccaggacggcggcaacgattactggcgcggcacctgcacctacagcaccacctttgccgctccggcgttcgatgcagcttcgcaggaagtctggctgcagttcgagggcgtcaattccagcgccaaagttctgctgaacggcaggaacatctgcacccacgacggcggctactccaccttccgtgtccatgtctccgacctgctggcaaaagacaaccagctcaccgtcgaggtggacaacagcatcaacgaccgcgtctacccccagaaggccgacttcaccttctacggcggcatctaccgcgacatcagcctgatggtggtcagcaagaaccacatcgcgctgggccacttcggcgacaccggcgtcaagatcacccccgtcctcaaggacggcaaggctgacatccgggtcgagaccatcgtggaaggtgagggcgctgtctccgtcgagctgcaggacgcagccggaagcatcgtggccagggctgagggcgcagacgctcagctccacctcggcgctccccacctctgggacggcgtgaaggacccctacctctacacctgtgtcgtccgcctgagcagcgacggcaccgtggtggacgaagtttccacccgcgtgggtctgcgcaccttctcggtggactccaggaacggcttcttcctcaatggccgtccctatccgctccacggcgtctcccgccatcaggaccgcaagggtgtgggcaacgccatcacccgcgagatgcacgatgaggatatggccctcatccgggagctgggtgccaacaccatccggctggcccactaccagcacgaccagtacttctacgacctctgtgaccagtacggcatggtggtctgggctgagatcccctacatctccgagcacctgcccaatggccgcgccaacaccatcagccagatgaaggagctcatctatcagaactacaaccacccctgcatcgtctgctggggcgtctccaatgagatcaccatctccaccaaggacaaggccgatatgctcgacaatcaccgcgagctgaacgacctgtgccacaagatggactccacccgcctgaccacgctggcctgctacgccatgtgcggccccttcaacccggtggcccacatcaccgacctcgtcagctggaacctctacctcggctggtatgtgccgggcctgttcctgaacgacctgtggatggacttcttccatctggtctaccccaaccgtcctctgggcttctccgagtacggtgccgagggtatgccgaacctccacagctcgaagccccgccgcggcgaccacaccgaagagtatcaggcaaagtatcacgagtacatgctccgctgcttcgaccggcataagtggatgtgggcgacccacgtctggaatatgttcgactttgcagccgacgcccgcgaccagggcggcgagccgggcatgaaccataagggcctcgtcaccttcgaccggaagacccggaaggacagcttctacctctacaaggcatggtggagcgacgagaactttgtccacatctgctccaagcggttcaccgaccgcacggagagcgagatggaagtgaaggtctactccaaccagaagtccgtcgccctctacgtcaacggcgagaaggccggcgagcagaccggcgagcacgtcttcagcttccgtgtgccgctgaccggcgaaatcgaagtcagggctgtggccggtgactgcaccgacaccgcttccttccgtcatgtggacaccccgaatcccagctacaagctggtcaagaccaagtccaagagtgcaaactgggtctga

SEQ ID NO: 2343 - DNA, 1881 bp, Unknown
  Artificiall/Consensus sequence
atgaatgtacgactcaaacgcgccaaagagctgatgggctatgccgtccagctcacgaaagacgagggcctgcccacgatggtaaagcggggcgcgggctttgtccgccgccgtttcttcggcaagcgggcgcgctatctgcccggcaaaaaggtgctggaagctcaggccgccgaaatggtcggcaagaccgctgagaactgcggcctgcccaccatctccatcctgaccccgctgtataatacgcccgaaaattacctgcgggaatttctgagctcctttgtgaaccagactgcccccaatggccagctctgcctcgcggacgcttccgacgacgcccaccccgaggtggagcgtgtcgtaagggaatatcagcagaaaaatcaacgaatcgtatacaaaaaggtcgaaaataagggcatcgccgccaacaccaacgccgccgagacgctggcgacgggcgaatatctcgccctcgccgaccacgacgatgtgctggccccccacgcgatgtacgcgatgggtaaggctgtcttgcagctccgcgaaaagggtgagccggacagtttcctctacagcgacgaggcgctcttcaccaaggacatcaaaaagccgatggtgggacacttcaagcccgattatgccccggattatctgctctgctgcaactacatctgtcatctggcagtcttcaagcgggcgctgtatgagcagctgggcggcgaacgccccgagtgcgacggcagtcaggaccacgacctcttcctccggctcatcgaacagaccggcggtgcggctcatctgccgcaggtgctctactactggcgggtccatgcgggttcgacctcgggcggtaccgatgccaagccctatgtcgcggcagctgccaaaaaggcactggccgaccatctgagccgcaccgggcgcaccggcacggtggaggacgggcttttccccagcacctaccgggtcaagtgggacatcgagggcgaccccaaggtgagcatcctcatccccaacaaagaccacaccgatgacctcgagaagtgcctgtacagcatctggtcaaagaccgagtgggataacttcgaggtcatcgtcatcgagaacaactccaccgacccggccacctttgcctattataaggatgctgagaagcggtacgagggcctgaaagtggtcacctggccggaaaagggcttcaacttctcagccatcaacaacttcggacggaaggcggcgcagggcgagtacctgctgctgctgaacaacgacgtagaggtgcggaacggcgactggctcaccgagctgctgcggcagtgcgcccaccccggcggtgcggccatctgcggcgcgatgctctactatcccgacgagacgctccagcatgcgggcgttgtcacgggtctgggcggttacgcgggccacagccataagtacaagaaggcgggcggcagcggctatctgttccgcgccgctaccgtgcaggacttctccgccgtcacgggtgcctgcctgctggtcaggaccagcgtgtgggacgaggtgaaggggctggacgagaagtttgccgtggccttcaacgatgtggacttctgcctccgggtgcgggacaagggctatcgcatcgtgtggacgccctacgcccagctgacccattacgagagcaagagccgcggcggcgacgagaaagaccccgtcaaggcagcgcgctttgccgccgagcagcaacggctgtatgacatccacggcaaggcggatattctggacgacccctattataaccccagcctgacccgagaccgggaggatttctcggagagcggcgatttgcggaacctcaaagagggaaaagtgacagtgaggtggcgaaacgcatga

SEQ ID NO: 2344 - DNA, 2421 bp, Unknown
  Artificiall/Consensus sequence
gagcaaacaatgaaagtacctttcagttggttaaaagaactcgtcgatattgacgttaccgcacaggagcttgaagaaaagcttttctcctgcggctttgaagtcgaggaactcatcccgctggacgccggcatcagcaaggtcgtcgtgggcaagatcgtggagatggagcctcaggaaggcacccatctgaccaagtgcgtcgtggactgcggcgagtatggccacgacatccgcatcagcaccggtgcggcgaacatgaagctgggcgactgcgtgcctgccgccctggacggctccaccctgcccggcggcatcaagatcaaggcccgcaagatgcagggcgtggagtccaacggcatgctctgctccggcgaagagctgggcctgaacgatgatctgttcccgggttccgaggtctacggcctgctcatcctgcccgaggattccgtccccggcaccgacatcgccccggtggtgggtctggatgactacatcttcgacatctccatcaccgcaaaccgtcccgactgccagtccgtgctgggcatcgcccgcgaggtggccgccatcctcggcaagcctctgcacatgcccgccatggactacaacaccgtctgcgacgccgacgagccgatcagcgtgaaggtggaggctccggacctctgcccccgctacatggcacactacgtccgcaatatccggatgagcgagtctccccgctggatgaagcgccatctggccctgtgcggcctgcgctccatcagcaatgtggtcgatattaccaaccacaccctgctggagatgggccagcccatgcacgccttcgacttgaacaaggtcgccggccgcagcatcaccgtccgccgcgccgtggaaggcgagaagatcaccaccctcgatgagaaggagttcaccctgaaccccaacaatctggtcatctgcgacgcagagaagccggtcgctctggccggcatcatgggcggtgcaaactccggcatggacgacaacaccaccagcctgctcttcgagtgcgctaccttcgcccgcgactccgtccgtaagaccagccgcgctctgggccagaacagcgactcttccgcccgctacgagaagggcgttgaccgccactctcccgagctgggccttgcccgcgccctgcacctcatccaggagctggactgcggtgacatcaccacgctggaatacgatctgaccgatggccgtcctctcgagcgcaagcacatcgtcaccaccccggccaagatctgcggcgtgctgggcatcaccgtgccggaccagaccatgatcgacatcctcaagcgccttgagttcaccgtggacgtgcaggccgacggcagctgggacgtctccgcacccctctaccgtgaggatgtggagagcttccccgacctggccgaggaagtcatccgtgagtacggctatgaccacatcgtacccaccttcctgaacactgccgctgtcaccaacggcggtctgaactacgagcagaagcagcagctcaagaccaagcgtctgctggccgcacagggcttctatgaggcttccacgctggcgttctattccaatgccgagttcgatatgctccatatcccggcggaggatgaagcccgcaaggccatccgcatcctgaaccccatcagcgagaacctgtccgtcatgcgcaccctgctggctccgtccatgctgaacgtcatcgtggacaacctcaagaagggcaacgctgagggccgcctgttcgagatggctcccgtctaccttgccaaggagctgcccatcaacgagcatccccacgagcgccagaccctctgcatcggtgccttcggccccgaagaggacttcttcaccgtcaagggcgctctggaagcactggctgagggctttgacctgaccttcacctatcagcgtgagaccaccagctggctccaccccggcatcagcgccgccgtctactgcaacggcaagcgtctgggtgtcttcggcaagctggccaacgagatcaacgcggagttggagatcgccaaggagcagaaggacagccagaacatctatctgggcgagctggactatgaggctctgatgtcctgcgtcgagggtgagctgcgctataagccgctgagcccctacgccgctgtcaagcgtgacctggctctggtctgcgacgaggctgtggcctgcggcgacatcgaagagaccatcaagaaggcaagccccctcatcacggaggtcaagctgttcgatatttatcgcggcgcaaaccttggcgagggcaagaagagcatggccttctccctgaccctcactgaccccgctgccgaagtttccaacgagcaggtggagcgcaccgtcaagaaggtgctgggcaacctgaagttcaagctgggcatcgagatccgctaa

SEQ ID NO: 2345 - DNA, 1608 bp, Unknown
  Artificiall/Consensus sequence
atgtcagaggtttatggaaagcagcaagggggaaagaccatgaaacgacgtgatttctgtaaagcgctggtttgcagtgcagctcttgcgcccgggctggcactgccccgggctgaggcggcggcaaaaagccagacggtgggccgggcagtcccggcaggcaattatacaatgtccttccgcagcgagctgagccagatggacatcgagcacgaatattactacagcgacagtttttttgcgcacagctccatccagtacgaccaccagctggcgctggcgacgctgggcatggtgacggctgctttcaatacatgggccagcgatgcgaaatactgggccaacgggaacgtgggccgcgagaacagcctcgacgcagcctataccaagctgggcttcggcgacgtgaaataccgctattatgatgtcgatgtgggcaaggcgggcgacttcgtgggctggtccacggcccgcaagaccatcaccctgaacgggaagcgcaccaccatcgtggcgctcatcctgcgcggcggcggctacggcggcgagtgggtgagcaatctgcacaccggcgcgggccacgcccacagcggcttcatcatcccggtgcatgaggtgtttgccgatttgaagaactatctggcggcagctcagcaaaagggagagctgggcgtcgtcaaactctggatgggcggctacagccgcggtgcggtggtggcgaaccttctggccgcccgggtcaacagggagctgtccggattagaacgggagaatgtcttcgtctacacctttgcgacaccggtggccctcggcccgcaggactaccccgacttgcagcaggactacgacaacaaccacaacgccgacggcagcctgaaagagagctggggcgagagcaacatcttcaacatcatctccagcggcgacatcgtgccgcatcttctgcccgaggagtggggcttccaccggaacggcaacgaccgcttccttccctccacccggaacgaggaagagctggaagacctgaacgagatgggcaggaatgatttcggcccgacgccgctggacttcagctggctggccaccgacaaagagacggacgaagtcatgctccgtatggaggagtacttcatctcccgcgagaactaccatgagaagtacgaagccgccctgatggacatgatacagtgcgccttcatccgctcggagaaggaggtcacgcagaacaaagttctggacgatggcgaggtcatccagcggctgcgcaccctcacccatctgaagaatatggattactggaagatctcccgcgccgtctgggcggcatccaccatgagccgtgccgtgctcaagcgggtcgatgcggagaatatccccatccgtgcgcagcagatcgtcgtgccgatcctggccgtgggcctttgctatggcctcgagagcgaggctgtgagcctcattgcaaagtacatcctgatgttcgtggcgatgaagagcgcgcccgacgacgccatccgggcggcgttctgccaccactgcgagaattacattgctctgatggaatattacgccccctcagagcactgcatggaagccaccacccgcacctga

SEQ ID NO: 2346 - DNA, 2832 bp, Unknown
  Artificiall/Consensus sequence
ttgatttcccttgcaatccgcccaggattgctgcggaaaatcgccttgtctgcggacaaaaattctcgtcatccggcgcgccctgcttacgaaaacaacttctatttattcatctgggaggatactatgaaagaactcgcaaaacagtatgatccgagccaggtggaagaccgcatctaccagttctggctggatggcggctacttccacaccaaggccgaccccgacaagaagccctacaccatcgtgatgccccctccgaacgtcaccggccagctccacatgggccacgccgtggacaacaccatgcaggacatcctcatccgcaccaagcggatgcagggctatgccgccctgtgggtgcctggcacagaccacgcttccatcgctacggaggccaaggtcgtggaggccatgcgtgctgagggcctgaccaaggaaatggtgggccgcgacggcttcctggagcgcgcctgggcctggaagaccaagtacggcaaccgcatcgtcagccagctcaagaagctgggcagcagctgcgactgggagcgtgagcgctttaccatggacgagggctgctctgaggctgtcaaggaagtgttcgtgcgcctgtacgacaagggcctgatctaccgcggcaaccgcatggtcaactggtgcccccactgcaacacctccatttccgacgccgaggtggagtatgaggaaaaggacggcagcttctggcacctgctctacccggtcaaggagaccggcgagatgctggaactggctaccacccgtcccgagaccatgctgggcgataccgctgttgccatcaacggcgatgacccccgctatgctcatctgcacggctgccatgtcatcctgcccctgctgaacaaggagatccccatcgtctgcgacgagcacgccgacatgaccaagggtaccggcgtcgtgaagatcaccccggcccacgaccccaacgactttgaggtcggcctgcgccatgacctgcccatcgtccgcgtcttcacctacgacggtcgcatgaccggcgccgccgacaaggctgctgccgacgctctgtttgctgcaggcaagaacaccgtcaacgagcctcatgtgctggactgcggcaagtatgccggcatgaccaccctcgaggcccgcaaggccatcctcgcggacctgaaggagggcggcttcctgaaggagatcgagcctctgaagcacgaagtcggcacctgctaccgctgccactccaccatcgagcccatggtgtccaagcagtggttcgtcaagatggagcctctggccaagcccgccatcgagagcgtggagaagggcgacatcaagttcgtgccggagcgcttcaccaagaactatatgaactggatgaagaacacccgcgactggtgcatcagccgccagctgtggtggggccaccagatcccggcctggtactgcgacgactgcggcgagactgtggtcgccaagagcgcaccctgcacctgccccaagtgcggcggcaccaggctcacccaggaccccgataccctcgacacctggttctcttccgctctgtggcccttcagcactctgggctggcccaatgaggaaagcgaagacctcaagtatttctatcccaccaacaccctcgtcaccggctacgacatcatcggcttctgggtcagccgcatgatcttctccggtctggcttacaccggcaaggctcccttcgacaccgtctgcatccacggcatcgtccgcgacagccagggccgcaagatgtccaagagcctcggcaacggcatcgacccgctggaagtcatcgcccagtacggcgctgacgccctgcgctttatgctggtggacggctctaccccgggcaatgacatgcgctacagcgagaagaaggtggaggctgcccgcaactttgcaaacaagctgtggaacgctacccgtttcgtgctgatgaacctgcccgaggacttccagcccggcctgcccagcgaggataagctggacatgagcgataagtgggtgctgaccaagctgaatcaggtggccggcgccatgagcgacaacctcgaccactacgagatgggtctggctgctgccaagatcaacagcttcatctgggacgtctactgcgactggttcatcgaaatcgcaaagccccgcctgaactccggcgacgccgagcaggccgacactgcccgccgcgtgctggtgtatgtgctggacaaggccctcaagctgctgcaccccttcatgcccttcatcaccgaggagctgtatcaggctctgcccggctctgccgagaccatcatgacccagagctggcccaccttcgatgaagctcacaactgggccgacgaagaggaagccttcgagaaggtgatggactacatcaaggctgtgcgtaccatgcgcaccgagatgaacgtccaccccgccaagaagaccagcatgatcatcgagacggctgacccggctcccttccagagcgccgaggtctatctggcaaagttcgccttcgccaccgatgtgaccttcaccggaaagtatgagggcagcaccgacggcatggtgcaggtgtccacccatgccgcccgcggcttcatccccatgatggagctcatcgaccgcgacaaggagctggcccgtctgaacaaggaaaaggccaaggccgagaaggaactggccatgttcgagaaccagctcaacaaccccaagttcgtcgagcgcgctcccgccgctctggtggaggacatccgcaataagcacgccaagagccaggacaagcttgccaacattgagcagagcatcaaggctctgggctga

SEQ ID NO: 2347 - DNA, 2661 bp, Unknown
  Artificiall/Consensus sequence
atgcaatggaccggtttgaatgaactgcgtgacaagtaccttaccttctttgagggcaagggccacctgcgtctggacagcttcccgctcgtcccgaagaacgaccccagcctgctgctcatcaacagcggcatggcacctatgaagaagtggttcctcgctcaggaggagccgccccgtcatcgcgtgaccacctgccagaagtgcatccgcacccctgacatcgagcgcgtgggcatcaccgcccgccacggcaccttcttcgagatgctgggcaacttctccttccaggattacttcaaggaagaggtcattccctgggcatgggagttcctgacttccgacgagtggatggctatcccgaaggataagctgcacatctccgtctacgaagaggacgatgaggcttacgacatctggaccaagaaggtgggcgttgcccccgaccacatggtccgtctgggcaaggaagacaacttctgggagcacggctccggcccgtgcggcccctgctctgagatctacttcgaccgcggccccgagtacggctgcggcaagccgacctgcggcgtgggctgtgactgtgaccgctatatggagatctggaacctggtgttcagccagttcgacgctgacggcaagggccattatgagcgtctggcacgccccaacattgataccggcatgggtctggagcgtctggcctgcgtgatgcagggcgtgggcaacctgttcgaggtcgataccgtccagagcgtgctgcaccatgtggagcacatcgcaggcaagacctacggtgccaaccccaaggaggacatctccatccgcgtcatcaccgaccacatccgcagctgcaccttcatggtgtctgacggcatcctgccctccaacgaaggccgcggctacgtgctgcgccgtctgctccgccgcgctgcccgccatggccgtatgctgggcatcagccgccccttcctcgtggagctggtggagacggtcatccagtccagcgagtccgcttaccccgagctgcgtgagcacgacgcctatatcaagaaggtcatcggcaccgaggaggcaaactttgcccgcaccatcgatgccggcatgaacatcctgaacaacatgatcgacggtctggaaaaggctcatgagcacctgctgaagggtctggacgtcttcaagctgaacgataccttcggcttccccctcgacctgaccaaggagatcgctgcggagcagggcatcgagatcgacgaggagggcttccacgccgagatgaccaagcagaaggagcgcgcccgtgcagagcgcctcaagaagaacatttccggctggagcgaagacctgttcggcactctgaccgctgagcccaccgagtttgtgggctacgacagcctcaagagcgacagcgtcgttgtggcgctgagcgatgaggaggctctgaccgacgccatcgccaccgacgagcaggccaaggaaggcgtgctggtcgttctcgataagaccccgttctacgctgagatgggcggtcaggccgcagaccatggcgtcatcaccggcgctgagtgcgtgctgcgtgtgcaggacgtcaagaagacccccaagggctactacgtccacacctgcaccctcgagagcggcatcgtccatgtcggcgaccatctgaccgcccgcgtggataaggaataccgcatggccatcgcccgcaaccacaccgctacccacctgctgcaggcagctctgcgcgaggtcctgggcgaccacgtccatcaggcaggctcctatcaggacgcttccatcacccacttcgacttcacccacttcagcgctgtcactcccgaggagctggtccgtgtgcagaagatcgtcaacgacaagatcttcgagtcgatgaacgtcaccgtcaaggaaatgcccatcgaagaggccaagaagctgggcgctatggctctgttcggcgagaagtacggcaaggtcgtccgtgttgttgatattgagggctggtccaccgagttctgcggcggcacccatgtcaagaacaccgctcagatcggcggcttcaagatcgtcagcgagtcctctgttgctgctggtatccgccgtatcgaggctgtcaccggccgcaatctgctgatccgtgcaaacctgcaggaagcgatgctgcataccgtggcgaacaccctgaaggcaaacaacgtcgccgctctgcccgctcgtgcggaggctgtcatggctgagaacaaggccatgagcaaggagctggaggacatcaaggcaagggtcgctgcttccaaggtcaccagcctgttcgacaacgctgagaccgtcggcgacgtcaagatcgcttccgcttacttcaccggtacctccggcgacaccctgcgcggcatgtgcgacaccatccgtgacaatgccaaggctgctgctgtggctgttctggtgggcaagtctgacgacaagatcaccatggccgttaccgtgaccaaggacgctcaggcaaagggtctgaaggccggcaatctggtcaaggagatctctgccatcgcaggcggcaagggcggcggcaagcccgacttcgctatggccggtctgaaggacgagaccaagatcgacgaggctctggccgctgtcaagagcatcgtggagaagcagctgggctaa

SEQ ID NO: 2348 - DNA, 2436 bp, Unknown
  Artificiall/Consensus sequence
gaggaaaatgcgatgaagcataccgacatcatccagaaactgaacttagagcaaaaatgcgccctgctctcgggcgagactgtctttaccacccgcgctctgccgggcaagggcatcccggccatcaccctttcggacggccccaatggtgtccgcaagcaggccggcgccgccgaccatctgggcctcaaccccagcgttccggcaacctgtttcccgacctcttccgccactgcgtgcagctggaatgagaagctgggcgaagccgtgggcgaggcactgggcgaggaagccgctgcacaggaagtggctgtcctgctcggccctggcctgaacatccagcgcagccccctttgcggccgcgacttcgagtatttctcggaagaccccatcctcgcgggcaggatggccgctgcctatgtgcggggcatccagaaaaacggcatctctgcctgccccaagcactttgcggtcaacagtcaggagctgcgccgcatggccagcgactcggtgctcgatgagcgcaccctgcgggagctgtatctgactggttttgagatcgtggtgaaagaggcaaagcccaagaccatcatgacctcctacaacctcatcaacggcacctacgccaacgagaatgcccacctgctgcaggacattctgcggaaggactggggcttcgacggggccgtcgtcaccgactggggcggctccaatgaccacgccctcggcgtgaagaacggctccaccctcgaaatgccctgtcccggcggcgactccatccgggagctgatgaaggccgtacaggacggcaaaatttccgaggccgacgtggacgcccgcctcgacgagatgctggaactggtgttctccacccacgctgcggtggaaaaagcgccccgcaccttcgacgcggccgcgcaccataagcttgcccgccgcgcggccgcagagagcatcgtcctgctcaggaacgagggcggcatcctgccgctcaagcccaatgagaagctggctgtcatcggcgattttgccgagacgccccgctatcagggcgcaggctccagcgccgtcaacgccctgcaggtggacaccctgctggacagcatcaaggccgacgacagcggcatcaccttcgtgggctatgcctccggtttcgagcgtcagggtgcagctgacgccgagaagctggaagaggctgtggccctcgcaaagaaggcggacaccgttctgctctgccttggcctcgatgagctgcgggagagcgaaggcctcgaccgctctgacatgaagctggccgagaatcagcagcagcttctggccgctgtggctgccgtcaacccgaacgtcgtcgttctgctgagcgccggtgcgccggtagagacgccgtgggtcggccagtgcagggcgctggtctacggcgcactgggcggacaggcaggcgcaggcgcggccgcagacatcctcaccggcaagctctgcccttgcggcaagctgtcccagacctgggcgcaggcttacgacgatacccccgccaaggcgaacttcggcggcgagggccggaacgtggagtaccgcgagggcctgtatgtgggctaccggtactatcagaccgccggtgtgccggtggcgttccccttcggctacggcctgagctacaccaccttcgagtacagtgatttgaaggcagacgagaagggtgtgaccctcaccgtcaccaacaccggcagctgtgccggtgccgagatcgtccagctctacgttgcaaagcaggacgcaaaagtcttccgcccggcgcaggagctgaagggctttgcaaaggtcttcctcgcccccggcgagagcaggatggtgagcatcgctctggacgacaaggcgttccgctactggaacgtcaagactgaccgctgggaagtcgaaggcggaagctatcagctccgcgtgggtgcatccagcgcggacatccgcctgacggcggaagtctccgtcaaggggaccaacgctcccgacccctacgagggtctcgacctgctccactacgtctccggtcagatcacctatgtgactgacgccgagttcgaggctctgctgggccaccctgtgccggaggatgtcgtccgcatcgaccggaacatgacgctgggcgagatggaccatggccgcagtccgctgggctgggtggcacagaaggtgctgcgctaccgtctggacagcagctttgcaaaaggcacccccgacctgaacaccgtgttccagtataatatgccgctgcgcgcgctggccaagatgaccaacggcatggtgagcatgggcatggtagacggcctcgtctgggagctgaaaggcttctggctcgtgggcatcctccgggtcatctatgagttcgtcaagaatctcatcctgaacagccagatggaaaaccgactcaaaaacagctga

SEQ ID NO: 2349 - DNA, 2121 bp, Unknown
  Artificiall/Consensus sequence
aggctcggcggtggcgaagccatgaaagccccagtggggcttttaagccgacagtccggtttgcgaagcaaatgccgcgtgtttagcgcggcaaggacagggaggcacgaactaggggttgctcgcccctttcagaccccaaaggagaagtcgaaacggaaaaaagctagccgcttcgctaaacgcttttttctcgtttctctgatttacggcttcgccgaagattttatgttgcaaatagaggaaagtatgaaccatttaggagactacgacgttatcgtcatcggtgccggccatgcgggcattgaggcggcccatgctgccgcgatgctgggcgcaaagacggcggtgttcacgatgagcttggacgccatcggcaatatgccctgcaaccccagcatcggcggaacggcaaaaggcacgttggtacgcgaattggatgctcttggcggcgtgatgggccttgcggcagatgccacctatttacagagccggatgctcaacaagggcaaaggtcccgctgtccacgctctgcgcgtccagaccgaccgcaagcgctatcatgaatatatgaagcacgcccttgagctgacgccggggctggccatccatcaggcggagatcatttccatcgaggtggaggacggccatgtgaagggcgtcgttacccagctgaacggggagtatggcgcaaagtgcgtggtcatcgccaccggcaccaacctcggcggaaaaattttcgtgggcgatgcatggtacgcttccggccccgacgggatgcacgcggccaacgccctcaccgagagcctgaaggccgccggtctgccgctgcgccgcttcaagaccggcacgcctgcccgggtgcatcggcggagcatcgacttcgccaaactggaatgccagcccggcgacccggacaatgagcttcagcctttcagcttcatgaccgatgcccctatgcacaacaaggtggagtgctggatcgcctacaccaaccctgagacgcacaggatcattctggacaatatccagcgcagcccgctctacggcggcatgatcgagggcgtcggcccgcgctactgcccgtcgatcgaggacaaggtggtgcggtttgcagggaaggaccggcatcccatcttcgtggagccttgcggcgagaacaccgaggaaatgtatctgcagggtgcgtccagcagtctgccggaagatgtgcagaatgcattctaccggagcatcaagggcttcgagaatattgagatcatgcgcccggcctacgccatcgagtacgactgcgtagaccccaccagcctcgaagccacgctggaaagcaaggtggtgcggggcctctacggtgcgggacagttcaacggtacctcgggctacgaggaagccgccgcgcagggcctgctggccggtctgaatgctgcccggaacgcagtgggcgaaagccagctcatcctgcccaggcagtcgagctatctcggcacactggtggatgaccttgtgaccaagggtgtcatggacccctaccggatgatgaccagccgcagcgagtaccgcctgaccctccgtcaggacaacgccgacacccggttgacgcccatcggcagggaatacggcctcgtgcaggatgaccgctggacaaagtaccagcagacgcaggctgtgctggacgcagagcgccgccgtctgcatgacgcccatctgcgcacggcggacctgcgcgccgcgatggaagcggcgggcctcgccccggccgcagagggcggcattgccgaagagctgctgcgccggccggagatcgactatccgctcatcgcgggcatgatcggctggggtgagggcatcacgcccatgctggccgagcgtctggaaactgagatcaagtacgcgggttacattgcccggcaggaccggatgatacacgaggtggcccgccacgagaagaccctcatcccggaggatttctcttacacagagctcaccggcctgacgctggaagcccgcgagaagctggcccgcatccgcccgaaaaacttggggcaggcgggacgcattcccggcgtgtcgccgtcggatgtggcacagctgagtattgcgctggcggcgaagagaagctaa

SEQ ID NO: 2350 - DNA, 2610 bp, Unknown
  Artificiall/Consensus sequence
aatatttctcttcgaattttcacaaaatcaccaaatgtagcttatcggacggaggttgtttatgagacgactgcgcagcccatccccggggatgaaactgcaaaaaaatcacgacaaaggaggacggacgctttgaacgaacacgaaaaaccacagatagacttcatgcacaagcttgcgcgccagatcgtggaacgccgcaaccttgtgttcctgtttgtcattctggctgccatcttcacggtgttctcggtgcggtgggtcaaggtcgagaccgacatgaccacctacctgcccaagacctcggagacccgcatgggcctcgacatcatggacgagcagttcacgacctacggctctgccgatgtcatggtggccaacatcacgcccgctgaggccgatgagctttccgaccggctcaccgagctcaagggcgtccagatgctggactacgacgacacgaccgaccattataataaggacgcggtgtcggccctttactccatcaccttcgactaccccgaggacgatgaccagtgcctcgaggcccttgaccgggtgaaggaatacctcgccgactacgacatctacgtctccacctcgctgggcaacacccagcaggagaccattgatgccgaggtacgggtcatcatggtgtacgttgccgtcatcatcgtcatcgtcctgcttctgacgtcccagacctacgccgaggtgcctgtcctcatcctcaccttcgtggtgggcatgatcctgaacatgggtacaaacttcatgctcggcaccatctccttcgtgtccaactcggtcacgaacatcctgcagctggcgctgtcgctggactacgccatcatcttctgcaaccacttcaaggaagaataccagaccatgcccctgaaggaggccgtcatcgagtccctgagcaagagcatccccgagatcagctccagctccctgaccaccgtcggcggccttgtggcgatgctgttcatgcagttccgcatcggctccgatatggccgtctgcctcatcaagtccatcctctttgcgatgctctcggtgttcgtggtcatgcccggcctgctgatgctcttcggaccctacatggataagaccaggcacaggaacttcgtgccggagatccccttcgtgggccgctttgcatggcgcacccgcaaggtcatccctgtcatcttcctggtggtcatcctcatcggttaccacttctcgaacctttgtccctacgcctacggctacgatgtcatcaaggtgccgaagatgaacgaatccctcatcgcggaccagatgatcgaagaaaacttcaccaagtcgaacctcgtggcactcgtctaccccaagaacgacgattacagcatcgagaaaaagatgctggaggagctggaaagctatgatgaaatagactccaccaagggtctgtccaacatcgaggcccaggacggctatatgctggaagacaagctcaccgcccgccagttctccgagatggccgatctggactacgaggccgcccagatgatctacaccgcctacgccatcgagaacgaggagtacggtcaggtcatcggcaacttcgcctcctataaagtgccgctcgtggatatgttcctctacgtctgcgacgaggccgacaccggcatcgtctccctctctcaggaagacctggacgacctccacgacgcccgcgaccagatggagagcgcactggcccagctgcagggcgacgactacaaccgtgtcctcatctacctgagcccctctctggaacccggccggactacttatgagttcaccgacaccatccgctccatcgcccggaagtattacccggacggcgagctctacatggccggtgacgccaccaacgagtacgatttccagaagtccttcgccatcgataatgtcgtcgtcaacgtcgtgtccatcttcatcgtcctgctggtgctgctgttcaccttccagtccgtcggtatgcccatcctgctcatcgtggtcatccagggcgctatctggatcaacttctcgttcccgtatttcatggggaccaacctctacttcatgggctacctcatcgtcagctccatccagatgggcgcgaacatcgactacgcgatcgtcatcgctacccgtttcaacgagctgaaggataagatggagcacaagcaggccatgatagagaccatcaacttcgcgttcccgaccatcctgacttccggcaccatcatgaccgtgtccggcctcctcatcggccggatgacttccgacgcctgcatcgtgggcatcggccagtgtctgggccgaggcaccatcatctccatcctcctcgtcctcttcgtcctgccccagatcctgctcatcggcacccgcatcgtggaccgtacctcctttgccgtgccgaagctggtggcccgcagcagcggcaatggccgtatgcgggtcaacggcatcgtgcagggcgagatccacggctccgtggccggtacgatgaacgccatcgtggacggcgatgtccagctgaccgtcatctcgggcaacgtctctcaggaactggacgacaacgaaaaacaggaggtgcagaatgaagaccagtaa

SEQ ID NO: 2351 - DNA, 1572 bp, Unknown
  Artificiall/Consensus sequence
aaatgctgccgaaaggcagcgggggaggcgcagatgttctttcggctgccggtcgtacggttcttcaatcgtgtcatcaacagggccacggttacagtggcccttgttttgctgcagatcggctggctgctctgggccttcttctccctcaccgccggaaaggtgtgggtgaatgcggggctgaacgtcctcagcctcttcatcaccctctacctcgtgcggaaagacgagaacagcgactataagatcatctggctcgtcctcatcggcatgatgccgctgctgggcggtgcgctctatctggccttcggcaacaaggcccccgccaagcggatgcgccagcggatgcaggcggtggagcgccagcacaccgccgacctcgcccagcagccgggccagaccgacgccctcgaccccgccagcaggggactgagccggtatgtttcggagtacgggccgtaccccgcatggaaaaactccacggcaaaatattacccctgcggtgaggccatgtaccctgacctgctggccgacctcgaaaaggcagagcggttcatcttcctcgagttcttcatcgtccgcaccggcaagatgtggaagggggtagaggacatcctcgtccgcaaggcggcgcagggggtggatgtccggctcatctacgacgatttcggcagtctgctgggtctgccgtccgatttcgtggtaaagatggagcgggcgcatatccgctgcatcccgttcaacccggtggtgccgctggtgtcgctggtcatgaatcaccgcgaccaccggaagatcgtggtcgtggacggaaatacagcctatacgggtggcatcaatctggccgacgagtatatcaatgaagaagagaggttcggctactggaaggacgcagccctccgcaccgagggcgcggcggtctggaacttcacggtgatgttcctcgaccactggaacgccttccgccccagcgaggaggattatgcgccctttatgcctcaggctgagtccctgtctgcccagtcggacggagtgatccagccctacggggacagcccgctggacgaagaggctctggccgagacggtctacctgaatatcatcaatcaggcccagcggtatgtctatatctatacgccctacttcgcggtgggcgagaccatgctggaagccctcaaggcggcggcaaagcggggcgtggacgtccggctggtgctgccgggcatcccggacaagaagctcatcttccggctgacccgctcctattatgtgccgctgctccgggcgggggtgcgcatctacgagttcacgcccggcttcctccacgccaagtgctacgtcagcgatgaccgcgccgccgtggtgggcagcatcaacatggattaccgcagcctcttcctccactttgagtgcggggcgctgctgctctataacagtcaggtcattgctctgcgggacgatgtgctccgcaccctgccagagtgccgggaagtgcagctggccgactgccgcacctcgctggccgggacgctgctggacagtgtgctccgcctgctgagcccgctgatgtga

SEQ ID NO: 2352 - DNA, 3759 bp, Unknown
  Artificiall/Consensus sequence
atgaagaccagtaaccatctgctgcgccgcctgacggctgcgcttctggccgctgtgctggcgctgagcatcgcactgccggtgttcgcgtctgacgacggcgataccatttacatcaacagcgtctcggacctgctttcgctggccaagagctgtgcctacgaccagtggtcggtgggcaagacggttattctacagaaagacctctccctcgaggggatgctgtgggagcccatcccgtccttcagcggacagttcaagggcaatggccacaccatctcggacctgaccattacgggccagtattccccggcgggcctcttcggcatcgtggaggaacagggctccatcgaatccctgagcgtgcggggcatcgtgtctgtctctgactctgccgacaccaccaccggcggcatcgtaggcatcaaccacggtaccctcatcaactgccagttcaccggcgtcgtcaccggcgacagcgaggtgggcggcatcgtgggccgcaacgagtccgaaggcaccatcgaccacagcactgcccgcgccatcgtcaccggcaaatcttccaccggcggcattgcaggctacaacctcggcgccatcaccggctgcaccaacgtgggcagcatcaacaccgaatatcaggaagcctctctcgacaccgacggcttcacggccaagatggtggaccagatcaacaacaagatggccgccgccgatgacgacgccaccaattccgtcaccaacgtcgccaccgacaccggcggcatcgcaggccgctcctccggcatgatcctgaccagcgtcaacaccggaactgtcggctacgagcatgttggctacaacgtgggcggcattgtgggccgcaccgacggcctcgtatccggctgtgtcaatcagggccatgttctgggccgcaaggacgtgggcggcatcgccggtcaggcggaaccctatcgcgaactcgacctctccaaggacaccatcaagcgtctccgttcggagctggatgttctgcgcggccttgtcgatgacaccaccggcgtcgtcgagaactccaccaccagcatctccaattccttcagcgccatgaccagccagatggacaccgccattgcagcggcacgccagctggacgatcaggccagcgactacggcgacgaggtggctgacgagatcgaccgcgcctccactctgctggccgataccctcaccaaactcgaacccgtcatggacaccggcgaagatgccatgaccaagctgaccgacgccaccggaaacctcaagtgggccatgcgcgagatggccgctgagatgctgatggcatccagcgccctcagcaagaccagcgacggtctgggcaaggtgagcgacgcggccgaggatggccgtgacggtatgtcggctatctctgagggtatcaaacagctgttggagtctgtcgataccggcgatgacagcgctgcctcgcaggcaatctccaccatcctgaccggctacgactctctctctgccgagaagaagtcggataagaacctcaagaccggcattgagctgctgaaggtggccaactctgtggccagcgtcttcacgctgggcagcggcatggccccggcaatgaaggccgtcaccgcaggcatgggcctgctgcgcacggcgtccctcctgtccaacgacagtgacattgcccgtgctacttcccaaatcgcaagtgccatcggcaccatctctaccattgccacccagatgggcggcatcgtgggcagcgctgccaagtccgtctcggcctccgaccaccccgagctggctgcggctctgaccaaagcctctgacgcgctggacggcatgggcagcatcaccgacggcatcatggacaacatcaaggactgggttggcaataacggcggcggcagcatcaaggatggtctcgatcagctgagcgatgcttccgacaagctgagcgacgccatggatgacctgagcgactccctcgacctgctcaagaccgacgccgccctcaccagtgcaacgctggcgcatacctccgtggccatgggccagatgcaggacggcctcggcggcctgaccgatatgatgggccagacccgcgacattctccactggctcaaccagcaggaccccatcaaggtgcctcgtccctcggcagaactgaccaacaccaaggactccctctttgatgctgtcagctccatcaacgacaagatgaacgacatcaacagcaccatgcgcaccgccagcaaccagctgaccgacaagatgcgcgccgtgaccgcacaggtcagcgtcgtgtccaacctgatgctggatgctgtggaagagatcagcgacccgggcagcaagaccatctacgaggatgagtcggaagacctcatcgcttcccagtccgacggcaaaattgagaacagcatcaaccgcggcaccatcgacgccgacatgaacgtgggcggcatcgccggtaccatgggcgtcgagaacctgctggaccccgaggaggacaacaaggacgagggtacctcgctgctgcgcacctcctataccgtcagcgccgtcctcaccggcaacatcaacgagggcagcatcaccgccaagaaggatatggtcggcggcatcgtcggccaggaggaactgggccttgtgacggcctgcgagtcctacggcgacgtcaccggcgtcaatcaggtgggcggcattgccggtgcggccagcgccaagctccgcggcaactgggcaaaatgcgccctcagcggtgaaaagtacatcggcggcatcgtcggtcagggtaccgacagcgaccttaccgacggcagcctcatcgccatcaacaaccgcgccatcgtctctgtgctggaaggccagcagtacgtgggtgctgtctccggcggacaggacggcgacttctatggcaacctcttcgtctccgacgatctgcagggcattgaccgcctgagccgcgtcggtcaggcagagccggtcacctatgagaccctgctggctcaggagaatgtgccggattccttccggaagctgaccctgaccttcaaggccgacggccacatcatcaagaagatcagctttgactacggtgcgtctttcactctggacgactaccccgagatcccccagaagaatggatactacgccgagtggagcacacccgtcctcgaccagctccacaccgacaccgtggtcaatgtggagtacacgccctacatcccgtctctgagcagcagcgtcacccgcgagaacggacgtcccgttttcttcgtggacggcttcttcggcggttccaacgccgtgcaggtcacccagcaggacatcacagccgatgtccacggtgtgacagagcagtggctgctggagttcaccgatgacggcaatgagacccaccagatccgttatctgacccccggcaaggccaagggcaaggtctacgtcaagcaggccgacggcagctggcataaggtggagacgggcagcttcggcagctacaccaccttcaccactaccggcaccgaggtcgaagtggctttcgtccctgcaaagctccccatctgggccttctgcgccggcggcgcagccctgctggtgctgctccttctgctggcaaagcgcatcaagtcgaagcacggccccaagggcgaaaagccccgcagggagaagaagggcaaacagcccgagatggcggacacccccgccgatgagctggatacccccatctctgagacggatatgcagtaa

SEQ ID NO: 2353 - DNA, 1293 bp, Unknown
  Artificiall/Consensus sequence
atgagcactgagcagaacaacggcaagcctgccgtaccccccaagcgcaatctgctgaacgaccgccgcatccggctcctgctttctttgctgggtgcagtcatcgcgtggatggctgtcaccatcgtcgtgcagcccggcaccaccaccaccatctataatgttccggtggactttacctatgattcggctgcctacacttcccggggcctgagcatcgtcaatgcagaggaaaaaacggtcaacctgaaactttccggcgacggctacaccatcggcagcctgtcggccaacgactttgtcgtttaccccgactggtccagcgtccgcgacagcggcgaaaagagcctgcgccttcaggtgcggagccagagcaccctgctcaccggggtgtccgtctccatcgacggcgacaacaccgtggacgtggtgttcgatgtggtggaagaaaagaccctgcccatccaggtgacgacgaattacctgaagatagcagacggctatatcctctacggcaccgacatctcgaaggagacggtgactctctccggacccagcaccgagctgagcaaggtggagacctgcaccgccgaggtgacctacaacggcgagctgaccagccccgtcactctggacaccggtctgcgtttttacacccgcagcggcggagaggtgaaatttgagtatactactctggaaacggacagcgtcgaggtcacgctgcaggtgtataagctggccaccctgccggtgaaagtcagctttatcaacgcgccccgcgactttgacccctcggtgctggtctactccctgagcaaaaagaccctcaatgtggccggcccggagtcccagatcgaccgtctgtccaccctgtcggtgggtaccatcgacctttccacctttgcactggataaggtgtacgaaatgcccatcgaactgcccagcggcatccgcctgctggacaacatctccagcatcacggtcagcttcgacagctcccgtctggaaaccaagaccatgaacctgcccgccagctgtgtgcaggtcatcaacctgccctccacctacaccttgaccgtggagacggagcggctgatgaacgtcaccctctgcggcccggccggttcgctggaagcactgaatccggaacaggtggtcattgagatcgacgccgacgacttctatgtcgccatcggccagcagaacatcgcctgccgcctctatgtgccggccaacgacaaaatttttgcgctgggcagctatgtggtgcagtgcaagatagaaagtaactga

SEQ ID NO: 2354 - DNA, 1494 bp, Unknown
  Artificiall/Consensus sequence
atgagacagaaagatacaggaacaccaaaaaagaagacgcgccgtgcggcgggccagatggtggcctcggcggtgatggctcttgccatcgcggtgggcggttttggcaccacagccctgctggcgtcccagcctgcgggtctgacggtggagccgtcggctctgctgtgggagggcgagaccgatgcggcccacagcaccaaaaaggaaacgaagaaaaataatacggaaactccgaaaaacgactctgcatcctctgaggcggagagcactgctgcgtctgccgcgcagccgtctgctcccagccagagcgtgaaagaagagcccgctgcatcggcggctccggctgcacccgcagaggagactgccgcagagcctgcagccccggaaacagctccttctgcccccatgatgggcggcatcgacgagctggaacaggagaacggcttcccccgcttacagcaggagaccgaggcactggccgccgaagaccccctgagcgccccggtggagcaggatgcggtgtctcagcccgccgagccggagacgaactccgaagagcagagcaccctgccggtgaagaccgaggaaggcaccatcctgctgacgccggaagagatacgcgcggcgctggatgcgggtacgctggatgcgagcaacattgatactgcctgtcttaccgacgagaacggcctgctgagctggctgtggaacctcctgttcgggaaaagagacgatgacagcagcaccccggctccggctccggtctattccggctggcgcaccgtaggcggcaagacctactattatgaccagtacaccaaccagccggtcacgggcatccagtccatcgacaacaagctctattacttcgacgccaacggtgtccagcagaacgccaccttcggcatcgacgtctccaaatatcagtcgaacatcgactgggagcaggtcaagacggcgggcgtcaagttcgtcatcatccgcatcggctaccgcggctacggcagcggcgcactggtgctggaccccatgtttgagcagcacttcaccaatgcccggaacgcgggcctcaaggtgggcgtctacttcttcagtcaggcagtcaacgagaacgaggcccgggaagaagcgcagggctgcgcctacgtcctgaatggccgcaagctggactaccccatctactttgatactgaggcctccggcggcaagaatggccgtgccgacggtctgggcgtcgaagaccgcaccaagtgtgccatcgccttctgcgaggaagtcaaggcccagggctatcagccgggcgtctacgcctccaccctgtggttccgcaagcgcatcgatctgaaccagctgaagagctacagcatctggaacgcccattataatgtggccggcagccccatcgcctgcgatatgtggcagggtacctgcaccgcccgcatccccggctacggcggacagatcgacgtgaacatcagctatgtgggctga

SEQ ID NO: 2355 - DNA, 3912 bp, Unknown
  Artificiall/Consensus sequence
atgaagttttccggtatgccaaagcctcccctcgctagggcaacgacgacgaccgccgccggtggcggaaacagggagtcgctgttggggccgcggtcagcaatacgcaagcaaagcgaagcggatgctgggtaccgcaacccggacaatggcacggcgtcagccgtgacggagaggtttagcccggaagaagaaatcgatacaggagggaaatacccaatggtatatcgtatctatgttgaaaagaaacccggcttcgacggcgaggcccagagcctgcgcaatgagctcgtctccctgctgggcatcaaggagctgaacggtctgcgtctgctcaaccgctacgacgtggaaggcatcgacgaggctctgttcgagcagtgcgtccccaccgtgttcagtgagccgccggtggataacacctatgcagagctgcccgtctccgacggcgtgtctttcgccgtggagtatctgcccggccagttcgaccagcgcgccgactctgccgccgagtgcatccagctcatcagccagggcgaccgcccgctggtgcgctctgcccgcgtctacctgctggaaggcaccctgaccgatgaacaggtggctgagatcaagaaatacgtcatcaacccggtggaggcccgcgaggcttcgctggacaccaaggctaccctgaaaatgaagtatcccgtccccaccgaagtggaggtgctggacggcttcaacgagctggatgaggcaggcctgaaaaagttcatcgacgagaagggcctcgccatggacctgggcgacatcaagttctgccaggagtatttccgctcggagaagcgcgacccgaccatcactgagatcaagatgatcgacacctactggtcggaccactgccgccacaccaccttcggaaccattctggatgacgttcagatcgacgatgccgtggtgcaggaggccttcgaccgctacatggccatgcgcgccgaccttggccgcgagaacaagccccgctgcatgatggacctggccaccatcggtgccaaggaactgaaaaagcagggcatcctgaagaacctcgacgagtctgaggagatcaacgcctgcaccgtgaagatcaagtgcgacgtcaacggcaaggatgaggactggctgttcctcttcaaaaacgagacccacaaccacccgacggagatcgagcctttcggcggcgctgccacctgcatcggcggcgcgatccgcgacccgctgtccggccgcagctacgtctatcaggccatgcgcgtcaccggcgcaggcgatcccctcaagcccgtcagtgagaccctgcccggcaagctgccccagcgcaaactggtgaccaccgctgccgccggttattcctcctacggcaaccagatcggccttgctaccggtcaggtggatgagatctatcaccccggctatgtggcaaagcgcatggagatcggcgctgttgtgggcgcaacgcccgcttcccacgttcgccgcgaatgccccgctcccggcgacgtcatcgtcctgctgggcggccgcaccggccgcgacggcgtcggcggtgccaccggttcctccaaggcccacaagctggacagtctcgagcactgcggtgctgaggtccagaagggcaacgcccccatcgagcgcaagctgcagcgcctgttccgccgcgaggacgcctgcaagatgatcaagcgctgcaacgacttcggtgccggcggcgtctctgttgccatcggcgagctggccgacggcctgtatatcgacctgaacaaggtcaccaagaagtatgacggcctcgacggcaccgagctggccatcagcgagagccaggagcgtatggctgtggctctggcccctgaggatgtggacaagttcatcgccatcgccaccgaggagaaccttgaggccacccccgtggcaaaggtcaccgaggaaaagcgcctgaacatggtgtggaacggcaagtccatcgtcaacatcagccgcgagttcctgaactccaacggcgctgagaagcaccagaacgtccacatcgagaaggggactgtctggcagccccagtgggccggcgtgaccttcgagcagaagatgaagaacatggtgggcgatttgaacgtctgcagcaagaagggcctttctgagcgattcgactccaccatcggcgcggccaccgtgctgatgcccttcggcggcgcatgccagctgaccccccagaacgccatggtcgcaaagctgcccgtggacggcgagaccaacacctgctccggcatggcatggggctacaacccctacctcatgagcgccaaccagtatgtgggcgcacggatggccgtcgtcgagagtgtgaccaagctggtggcctccggcttccgctatgaggacgcctacctgaccttccaggagtactttgagcgccttggcacttccccggagcgctggggcaagccgctggccgctctgctgggcgcactggacgcgcagattggcctcggcatcgcctccatcggcggtaaggacagcatgtccggctccttcgagcagctggatgtgcctcccacgctggtgtccttcgccaccgccatcggcaaggccggccgcgtcgtctccaccgagttcaagaagcctgagagcaccgtcgtcctcatccggcccatcctggaccccgtcaccggctgccccaacttcttctccctgaaggccaactataagaaagttgagcagatgatggaagatggcatggtggccgctgcttcctctgtgggctatggcggtctggccgaggctctcttcaagatgggtctgggcaaccgcatcggcttcaagatgatgaacaacatgaccacccacgatatgtttaagcccatgtacggctccatcgtgctggagatggtctctgacgccccggctggtgagctgctgggcgagaccaccgcagactacaccttcgagtgctgcggcgacaagctggatatggcccagctgcaggagatttgggagagcaagctcgagcccgtctatccctaccgcaaggctggccctgtcgtcgagaagatcgacggcagcctgaccgcccccgctgcgcccaagatcggcgtggcaaagccgaaggtcatcatcccggtcttcccgggcaccaactgcgagtacgacaccgcccatgcctttgcccgcgccggtgcggaccccgaggtgctggtcatccgcaacctgacccccgctgacgtcaccgccagctgcgaggcactggtcaaggccatcaacgagagccagatcgtcatgctgcccggcggcttctccggcggcgacgagccggacggcagcgcaaagttcatcgcctccttcttccgcaatcctgtggtcactgaggcggtccgcgacctgctgcagcaccgtgatggtctgatgctgggcatctgcaacggcttccaggccctcatcaagctgggtctggccgcttacggcgacatccgccccatcacggcctgcgacccgaccctgaccttcaacaccatcggccgccaccagagtatgctggtgcgcacccgcatcgcctccaccggcagcccctggctgtccaagtgcagcgtgggcgaccagcacaccgtggccatcagccatggtgagggccgcttcgtggcacctcagagcgtgctggacaccctcatcgccaacggccagatcgcgacccagtacgtcgatcaggacggcagccccagcatggacatgaagtacaaccccaacggctccgtcctcgccatcgagggcatcaccagcccggatggccgtgtcttcggcaagatgggccattcggagcgcagcggcgagtacctgtacaagaacgtcaccggcgacaagtatcagcctattttcgagggcggcgtggactatttcaagatttga

SEQ ID NO: 2356 - DNA, 1569 bp, Unknown
  Artificiall/Consensus sequence
gaggctgtaaaaatgaatctgtctctcatccgttccatgacccgcagcgccgtcttcgagctggaaaacggcaagtgcttccgcccggagcaccccttcgccgtggctctgaacggcaagaccatttacgaaagctgcaacaccaacgtgttctccctcttctccctgactccgtccaccgcctacaccgtggaggtggacaccgagggtgagcacctgaaactggatttcaccaccgaggccgagagcttctttgtggacgcatcccgctacggcctcgtcgccgatggcgagaccgacaacaccggcaggctgcaggctgctctttccacctgccccaggggcggcacggtatatgtccccgctggccgctaccgcaccgccagcctcttcatgaagagctgcaccaccctctacctcgagaagggcgctgtgctgctgggcgacaacgaccgcacccactaccccatcctgcccggcgtcatccccagcgagaacgaagtggacgaatactacctcactggctgggagggcaacccgctgaacagctttgcgggcctgctgaacatcacccaggtgcatgacgtcgtcgtcaccggcgaaggtacgctggactgcgacgcccagaacggcgactggtgggtcgaccccaaggtcaagcgcatcgcatggcgtccccgcgccgtggcgatggtggacagcgagaacgtctgcctccacggcatcaccgtgcagaacagctactcctggaccatccaccccatcttcgtcaaacacctcgacctgctgaacttcaacatcaacaacccctacaacgcccccaacaccgacggcatcgaccccgaaagctgcgagtacatccgcatcatcggcgtgaacatccacgttggtgacgactgcatcgccatgaaggccagcaaggtcttcctcggcatgaagctcaagaagagctgcgagcataccgtcatccgcaactgcctgctggacaagggccacggcggcatcgtcatcggcagcgagatgagcggcggcgtcaaggacatggtggtcacccagtgcctcatggaccacaccgaccgcggcctccgcgtcaagacccgccgcggccgcggcaacaccgccgtcatcgacggtctggtgttccgcaacgtagagatgcggggcgtcaaggctcccttcgtcatcaatatgttctacttctgcgacccggacggccacggcccctatgtccagtgccgcgaggctctgcccgtggacgagtacaccccgaagctcggcaccctgaccatggaagacatcgtggccaccgacgcacagtttgcgggctgctactttgacggcctgcccgagcagcccatcgagggcgtctccatgaagaacgtcaccatcaccttcgaccccgacgcaaaggagggtcaggctgccatggccgacaaccgcccgctggtcaagaagctggccatctacgccgagaacgtcaagaacatcgagctgcacaacgtcaagatcgagggctacgagggcgagcgcctgcgctttgccaacgtcggccattttgaggaggactaa

SEQ ID NO: 2357 - DNA, 1419 bp, Unknown
  Artificiall/Consensus sequence
cgcacttttgtcggaaaagtgctctgctgtaactttttgaaaacaggagcggtacagacaatggcttggtatgacaatgcggtattctatcacatctatcctctgggattgtgcggctgtgcgcatgaaaacgacggacagcctgtccccggggctttcaaaaagctggatgcgtgggctcagcacgcggcaaagcttggctgtacggcgatctatatcggcccgctgttcgagagcggttcccacggctatgacaccatcgactaccgtctggtagaccggcgtctcggcaccaatgaggaattcaagcagtttgtcgccgcctgccatgagcggggccagaaggtcatcgtggacggcgtgttcaaccatgtgggccgcgatttcttcgcgttccaggagctgaaggagcaccgcgagaacgcccgctatcgcgactggttctgcgacgtgaatttctggggcaacaacgagtacaacgacggcttctcctacggcaactggggcggcttcaacctgctggtcaagctgaaccagcgcaaccccgaggtgcagaactaccatttcgataccatccgcttctgggtggatgaatttgatattgacggcatccgtctggacgctgccgacgtgctggacttcgacttcatgaggggcctgcgccgcgttgccaacgaggtgaagcccgagttctggctgatgggcgaggtcatccacggcgactacagccgctgggcaaacccggagatgctccactccgtcaccaactacgaactgcataagggtctgtggagcggccacaacgaccacaactatttcgagatcgcccataccatgcggcgtctgcagggcctctgccacgatacccggctctataacttctcggataaccacgatgtggagcggctgcccaacaaactgcgcaaccgcgagcacatccggcatattgctcttctagtatatacgctttggggcattccgtccatctattatggctcggaatttggcatcgagggcaaaaaagagtggggcagcgactggccgctccgcccctgcctcgagctggccgactacaccgacgccgagaagacgaaccctgtcaccagcatctatgccgcactgggcaggctgaaagcggagtgccccgagctgagctggggcgagttcaaggagctgacgctgaccacccagagctacgcctacgcccgggtgctggacggcaaggctgtcgtggcggtgtacaataacggtgacagcccggtctcgatggaattccagctgccggtggaggcttcgggtgtcgaagacctgctggccgactgtgtgggcagtcagcccatcctgacgcaggtggagtggggtaagctgaaagtccagctgccctccaactacgccaccctgctgcggctggtaggataa

SEQ ID NO: 2358 - DNA, 2253 bp, Unknown
  Artificiall/Consensus sequence
atgatcgattttgaacagtgggaaggctttgaaggccgcatctggaaagaggaagtcaacgtccgcgactttatccagaagaactacaccccttatgacggcgacgagtctttcctggctggccccaccgaggccaccgataagctctggggcgcactgcagaagctgcagaaggccgagcgtgccaagggcggcgtgctggatatggagaccgaggtcgtcagcggtctgaccgcgtacggccccggctacatcgacgagagcctgaaagagtttgagcagatcgtcggcctgcagaccgacaagcccctgaagcgtgcattcatgccctacggcggtattaagatggcggagcaggcctgcactacctacggctaccagccctctgaagagctgcacaagatcttcaccgactacacccgcacccacaatcaggctgtgttcgatgcctatacccccgagatgaagaccgcccgccacacccacatcatcaccggcctgcccgacacctatggccgtggccgtatcgtcggtgactaccgccgtgtggcactgtacggcatcgacgccctcatcaagttcaagcaggaagacttcgccaactgcggcgacggcaccatgaccgatgacgtcatccgcctgcgcgaagagatcgcacgccagatcaacgccctgaagggcatgaagaagatggccgaggcttacggctacgacatctctcagcccgctaagaccgccaaggaagcctgccagtggctgtacttcggctatctggccgccatcaagacccagaacggcgccgctatgagcgtgggccgcatctccaccttcctcgatatttatatccagcgcgatctggacaagggcatcctgaccgagagcgaggctcaggagctcatcgaccacatggtcatgaagttccgcatggtcaagttcgcccgcatccccagctacaaccagctgttctccggcgaccccgtctgggcaacgctggaagtgggcggcatcggcatggacggtcgcagcatggtcaccaagaactgctaccgcttcctgcataccctcgagaacatgggccctgcaccggagccgaacctaaccgttctgtactcctctgctctgcctgagaacttcaagaagtacgccgccaaggtgtccatcaacaccagttccgtccagtacgagaacgacgacgtcatgaagcccgtctggggcgacgattactccatctgctgctgcgtgtctgctacccagaccggcaaggagatgcagttcttcggcgcacgtgccaacctggcaaagtgcctgctctacgccatcaacggcggtgtggatgagaagagccacgagcagtgcggccccaactacgcccccatcaccggcgagtacctgaactacgacgaggtgctgcccaagtacgtccagatgctggactggctggccggcctgtacgtcaacgtgctgaacctcatccagtatatgcacgacaagtactactacgaagaggctgagatggccctcatcgacaccgatgtccgccgcaccttcgccaccggtatcgccggcttctcccacgtcatcgactccctgagcgccatcaagtacgccaaggtcaaggtcgtgcgcgacgagatgggtcttgccaccggcttcgaggtcgagggcgacttcccgaagtacggcaacgacgatgaccgtgccgacgagatcggcgtctggctgctgcgcaccttccttgagatgatcaagaagcgccacacctaccgcaactccgaggctacccactccatcctgaccatcacctccaacgtggtctacggcaagtacaccggcgctctgcccgatggccgtgccgcattcaccccgttcgcacccggtgccaaccccagctacggcgcagagcagaacggcctgctggcctctctgaactccgtggccaagctgccctaccactgggctctggacggcatctccaacacccagaccatcaaccccgacgctctgggccacagcgagggcgagcgcattgagaacctggtgcaggtcatggacggctacttcgaccagggcgcacaccacctgaacgtcaatgtcttcggcaaagagaagctcatcgacgctatggagcaccccgagaaggaggagtatgcaaacttcaccatccgtgtctccggctacgccgtcaagttcatcgacctgacccgcgagcagcagatggacgtcatctcccgtacctgccatgcagctctgtaa

SEQ ID NO: 2359 - DNA, 1518 bp, Unknown
  Artificiall/Consensus sequence
gatatttgcaattcatttgcctatgatagattaaaaggagaaatcattatgccgaacaataatatccgcacccgttttgctccctcgcctacgggttatatgcacgttggcaacctgcgcacggccctgtacacctacctgatggccaagcacgatgacggcaccttcatcctccgcatcgaggacaccgaccagggccgctacgtggagggcgctgtggatgtcatctacaacaccctgcgggagaccggcctgctgtgggacgaaggcccggacatcggcggccccgtgggcccctatgtgcagagcgagcgcatgggcatgttcaagcagtatgccgagcagctggtggctgagggcaaggcctattactgcttctgcaccgaggagcgtctggaagccctccacgccgagcagcgcgcccacggtgagatgacccactacgatggctgctgccgcgacctgcccaaggaagaggtggaaaagcgcctcgccgccggtgagccttacgtcatccgccagaagatcccccgcgagggcgtgactggcttcgacgatatggtctacggccacatcgaggtcaacaacagcgagatggacgaccagatcctcatcaagaccgacggtatgcccacctacaacttcgcaaatgtcgtggacgaccacctcatgggcatcacccacatcatccgcggcagcgagtatctgtcctccaccccgaagtataacctgctgtaccaggctttcggctggaacatccccaactatatccactgcccgccggtcatgaaggacgctcagaacaagctgtccaagcgcaacggcgacgccagctatcaggatcttgttgcaaagggctacctgaccgaggctatcctgaactacatctgcctgctgggctggagccccaagggcgagtacgccgagcaggagatcttctcgctggctgatctggtcaagatctggacgccggacggcatctccaagtctcccgccatcttcgaccccctcaagctgcgggccatcaacgccgagtatatccgccgcctgtcccccgaggagttcctcgccaaggctgagccctggatcgacagcgccgtccatacccccatcaacaagaagctgctctgtgcaaacctgcagccccgctgcgaggtcctgggcgagatccccgagcagctggatttcttcgacgccatgcccgagtatgacgtgagcctctacgccaacaagaagcagaagaccacccctgagtccgcaaaggaggcgctggaagccctgctgcccgtgctgagcgacgaggcactggacttcaatgaccgtgacaccgtcttcgatgcctgcaaggccaaggccgaggagctgggcaagaagaatggctggctgctctacccgctgggcatcgccctctccggcaagcagcgcacccccggcggcggcaccgacctcgcctgcatgatgggccgcgaaacgaccctcgagcgggtgaaggccgctatcgagaagctgaatggctga

SEQ ID NO: 2360 - DNA, 1599 bp, Unknown
  Artificiall/Consensus sequence
atgtacagcagttataccactctgcagcgggttcagctcgccaaacaggaatatctcgacacccaggaagtttttctcggcgtctatgcgccggggcggaacgccgccctgaaagcttccctgcaggaccagctccaccgcaaatttttattgacggacagcctccgccccgaagccctcggcagcgccgtcggtgtgcttctggtcagggaagaccttttcctgacgcccacggccctttcctgctttgcggacgcactgcgcagcggcgcagactacgtcaccagcgacgccgtcttcggctactcgggcgtcaccaccctctaccacagccagggctttgcagcctgcccgggctgcgccctcgtctcccgggagctgctgcgccgctgtcaggcggaagcccgcgacccggaaaatcccgtcgaactgctgacgctggcggcgaagctccgccgcagccacgtctgcctcccgctggcgctggcccactatgagcgggatatctgcgccgaagacgtctggtctgtaaaggggaagcgcgtctttatcatgagccacctgctggacatgaccggtgcgcccatcgtgctggtgagcgccgtgccggtgctgcgcagcatgggctacgaagtggtcgtcctcggccctgaggacggcggctccatgccgcttttcctcgaggcgggagctaccgtcatcacccgcaagggctgtgtccagtcgcccctgctctgggggctggccctctgcgccgacctcgttctggccaacaccgtcgtggaggcccgggccgtccgcgccctgagcggtgcgcgggtgccggtgctctggtggctccacgatgcctttgcaggctacccccacatcgcccaccagatccccagagagctgggcgaaaacatccggctctactccgtcggcagccatgccgccaacgccatgcactcggttcggccggagttcaacatccggcccctcatctacggcctgccggactacgccgccgagaagttctcccactacgatctgagctatgcgggcggtcggcctctgttcgccaccgtgggttccttcgagaaccggaaaggccaggacatcttctgcaaggccatccggctgctgccgcctgagaccatgaagaaggcatccttcctcttcgtgggcaaggccgcagaggctgagatgatggacgccgtgcggagcctgaccgctgactgccctgacaacgtcttttatgtcaagcggctcacccgcgacgagatcaagagtctgatggcccagtgtacctgcctcgtctgcgcctcccgcgacgaccccatgcctactttcgtcaccgagggcctcatcttcggcaagcccgccatcgtgtcggagcacaccggcaccgccgggctcatcaccgagggcgtggacggtttcgtctacgaggacgacgaccccgaaaagctggccgagcggctggcctgggccatcgagcacccggaaaagctggccgccatgcgccccgcctgccgtgagctttacgagagccattactccaagcaggcgttttccgacagtttacaacaggctgtaaaggagctcaccggcgagtaa

SEQ ID NO: 2361 - DNA, 1731 bp, Unknown
  Artificiall/Consensus sequence
atgaatttgtccattatggtcaaaaattacaaaggtaaggtgtgcaatatgtatcaggatgagtataagcgctggctggcagcggatctggaggacgcagatctgaagccggagctggctaaggtcgagggaaacgacgacgagatcaaggaccgctttgccgttgcactgaagttcggtaccgccggcctgcgcggcgtgctgggcgctggcaccaaccgcatgaacatctacgtcgtgcgtcaggccacccagggtctggcaaactgggtcaagacccagggcggcaatcagaccgtggccatcagctatgacagccgcctgaagagcgacgtctttgccaagactgccgccggcgttctggccgcaaacggcatcaaggtgcgcatttatgatgctctgatgcctgtcccggccctgagctttgccacccgttactatgagtgcaatgcgggcatcatggtcaccgcttctcataaccccgccaagtacaacggctacaaggcctacggccccgacggctgccagatgaccgatgacgccgccgccatcgtctatgacgagatccagaagaccgatgtcctgaccggcgcaaagtacatctcctttgccgaaggcgtcgagcagggcctcatccgctttgtgggcgacgactgcaagaacgccctctacgccgccattgaggcacgtcaggtgcgcccgggcctgtgcaagaccgccggcctgaagctggtctacagcccgctgaacggttctggtctggtgccggtcacccacgttctgaacgacatgggcatcaccgacatcaccatcgtgccggagcaggagtaccccaacggctacttcaccacctgctcctaccccaaccctgagatcttcgaggctctgaagctgggcctcgacctcgccaccaagaccggcgccgacctgatgctggccaccgaccccgacgccgaccgcgtgggtatcgccatgaagtgtccggacggcagctatgagctggtctccggcaacgaaatgggcgctctgctgctggattacatctgcgctggccgcatcgagaagggtaccatgcccaaggaccccgtcgccgtcaagtccatcgtctccaccccgctggccgatgccatcgccgcccactacggcgttgagatgcgcagcgtgctgaccggcttcaagtggatcggcgaccagattgcaaatctggaagctgccggtgaagtggaccgcttcatcttcggcttcgaggagagctacggctatctggccggtccttatgtccgtgacaaggatgctgtcatcggctccatgctcatctgcgagatggccgcttactaccgcagcatcggttcctccatcaaggagcgtctggaagagatctacaaggaatatggccgctacctgaacaaggtggacagcttcgagttccccggcctgaccggcatggagaagatggcctccatcatgcagaagctgcgtgacaagcccctcaccgagctggccggccacaaggtggtcaaggtcaccgactacaagaagcccgaagagaccggcctgcccgccgcaaatgtccttatctactctctggacaacggcgctaccgtggtcgtccgtccctccggcactgagccgaagatcaagacctacttcaccactctgggcaaggacctggccgatgctcaggctcagaaggatgctctggcagctgccatcgagcccatcctcgcataa

SEQ ID NO: 2362 - DNA, 1668 bp, Unknown
  Artificiall/Consensus sequence
ttgtcgcattttccggcctattttcagcatataaaaacagaaaagcccacgatatgcgccgcattttcaacggccaatcgtgggcttttctttggtgcgctcgagggaactcgaatccctggccctctgattaaaagtcagatgctctaccggctgagctacgagcgcatattttcagatttacagatactgccgaattatattaccacacccgcgccaaaaaagcaagaggaaagcgcaaaaaagtgcctttccgcagcacacagaccccccgccgggagagcacccgttccttttataaaagccagttttgcagtcacttctctgggacgcggatattctggcggcaacttcctctttacaaatggggcgcgaaccagtacaatcaaagcagaacgaactgtcccggcccgtatgcggcggggctttttgataggaggctgttttatcatgaaaatctctcgtcggtctgtccttcatatttccgggctggcagcggcagcgctggccctgaccggctgctctgcggctggaagcgccgcgctgggcggcaagctgcccggcctgctcaagagcctgaccaaaaaaggggagaccgctgcttcgtcggaagctgccagcgacatggccgtcaccccgccgcccgagggcgaacagcttgacccggccttcggcgtcatgcccgagtacgacgccgacatcctcaccggcgccgcgcgcagcaccaacagccgcccggtggctgtgatggtgaacaacatcgccaactcccagcgccagaatgcccgcccccagcggggcatcggcagcgccgacctgctcatcgaggccaaggtcgagggcggcatcacccgcctgtgcgccgtgttcagcgacgccgaaagcatccccgaggtgggtcccctccgctcgggccgcgaccagttcctgcagctgctcatgccctggaacatcctctactaccacgacggcgagagcatcttctgcacccagttcgtcagcgtctacggctactccgggctgaacatcggcggcaagaattatttcaagaccccgatccaccccatcgtctctcaccgcaataaccgcggccgcgatgtggcctacgagcacaccgagttcacctccggcaaggagatctgcaaggccgcttctgatgccggcatcagcctctacgctcccagcgaggggacattcttccacttcgccgactaccgcaccgacgaggtcaacaagctcaagggtgagccctcggccaaaaaaatcgccatcgtacattcggagagctaccgcacctcgttcagctactccgcactcagccacacctacgcgatgcagatgtacaactcctccaagaaggccaccgagaacaccgttgatgagctgaccggtgagcagcttaccttcgagaacgtcgtggtctgcttcgccgacatggacgcctacgcaggtgactcccacgacgtgcaggaggtgcagtacatcaagggcggcgacgcctacctcttcacccgcggcggcgtgcaggtgggccgctgggaaaagacctatcctaccaaccccctcaagctttataccaagtccggcgaggagatgaccctcaaccggggcaagacctactttgcactggtggacaacgacgagctgagcaatttcagttaccagtaa

SEQ ID NO: 2363 - DNA, 1218 bp, Unknown
  Artificiall/Consensus sequence
tcgcaatttctcctgctatacttagggcaaaggagcggcgggcagacccccgccggagaaatggctatggagtatcgcgattggacgaaaaaagacggcagcgggcgggacatctccacctccctgctgggctacgggtgtatgcgctttcccaccctgccggatggccgcatcgacgaagtgcgggccgaaaagctgctgaacactgcccgggaggcgggcgtcaactactttgacaccgctttcccctaccacggcggtgagagcgaacctttcgtgggccgggtcattgccaagtggcctcgggagagcttctacctcgccaccaagctgcctctgtggagctgcaagaccctcgacgaggccaaagacatcttcgagaagcagttcgagcggctgggcgtggactacatcgacttctatctgctgcattccctgcacaaagcccgctacgacgcggccaaagagatgggcattgtggactggctctgggagcagaaggccgccgggcgcatccggaattttggcttctcctgccacgacaacgcggcgggcttcgagcatatcctgcgcgaccagccgtgggacttctgccagctgcagtacaactacctcgacaccgacgaccgtgccgaggagatcgcaggagaccggggctatgctcttaccgaagaactaaatgttcccctcatcatcatggagcccatcaagggcggtacgctggcacagctgccgccggacgctgccgcgccgctgaatgcactggacgcagacgccagcgcggcctcgtgggcgctgcgctgggcggccagccacaaaaatgtgaaggtcgtcctctccggcatgagcgcagaagaccagctggacgacaacctcgccaccttcggagatttccgccccatgaccgacgccgagaacgccgccatccggcagactgccgacgtcctgcgcagccacatcaaaatcggctgcaccggctgccgctactgtatgccctgccccatgggcgtggacattcccgacaatttcagcatctggaacaagctcgggatgttcggcaataaggacgccatccgccagcagtggacagcccgcttcccggatgctgaaaaggccattcactgcgtccgctgcggcaagtgtgaggccgtctgcccccagcatctgccgattcgggactctcttgcagagctccagacggaactggacaatttataa

SEQ ID NO: 2364 - DNA, 2613 bp, Unknown
  Artificiall/Consensus sequence
atgaataccaatcaatatacccagaagacccttgaggctctgcaggcggcgcagcagctggctgtggagtatcagcataacgcactggagccggagcatctgctccacgctctggcgacacaggagcagggccttatcccccagctgctccagaaactgaatgtggacgcaggcagcttctccgccgctgtggccgaaaagctttccgcaatgccccgggtgtccggctctggccgtgaccccgacaaggtctatatctcgcaggccaccgacaaggtgctgagcgccgccgcccgcgaggccaaggccatgaaggacgactacgtcagcgtcgagcatatcttcctcgccctgctggacgagcagacccagaacacctccgagctgttccgtgcctttggcatcacgaaggataagttcttacagcagctcaccgccgtgcgcggcaaccagcgcgtgaccaacgacaaccccgaggacacctacaatgccctgcagaagtacggtcaggacctcgttgacctggcccgcaagcagaagctggaccccgtcattggccgtgaccaggaaattcgaaatgtcatccgcatcctgtcccgtaagacgaagaacaacccctgcctcatcggtgagccgggcgtcggcaagacggccatcgccgagggtctggcccagcgtatcgtccggggcgatgtgccggagaacctgaaagaccgtaccgtgttcagcttggacatgggtgctctggtggctggcgcaaagtaccgcggcgagttcgaggagcgtttgaagagcgtcctgaatgaggtgaagaagagcgagggcaagatcatcctcttcattgatgagctgcacaccatcgtgggtgccggcaagaccgacggcgcaatggacgccggcaatctgctgaaacccatgctggcccgcggcgagttgcactgcatcggcgcgaccacgctggacgagtaccgccagtatatcgagaaagaccccgctctggagcgccgcttccagccggttcaggtggatgagcctaccgtggaagacaccatctccatcctgcgcggcctgaaagagcggtacgaggtgttccacggcgtgaagatcagcgataatgcattgatcgccgccgccaccctctctgaccgctatatcaccgaccgcttcctccccgataaggccattgacctcgtggatgaagcctgcgccatgataaagaccgagatggacagtatgcccagcgagatggacgacctcgcccaccgcatcacccagctgcagatcgagcaggtcagcctgaaaaaggagaccgacgctctgagccagagccgtctgcgcgacctcgaaaaagagctggccgagctgcaggataagttccacagcatgaaggcaaagtgggaaaacgagaagaatgccatcggcaaggtgcagtctctgcgcgagcagatcgagcagaccaacgccgccatcgaaaaggcacagcgcgaatacgatctgaacaaggccgctgagctgaaatacggcaagctgcctcagctgcagaaacagctggaagaagaagagaagatcgccgccgccaagaaggaagacagcctgctgcgcgaccgcgtgaccgacgaggagattgcccgcatcgtggcccgctggaccggcatccccgtggagaagctggtggagggtgagcgcgagaagctgctgcatctggacgatgtgctccacaagagagtcatcggccaggatgaggccgtcaccaaggtgagcgaggccatcctgcgcagccgcgccggcatcgcaaaccccaaccgcccgattggcagcttcctcttcctcggccccaccggcgtcggcaagaccgagctggcaaaagctctggcacaggctctgttcgacgacgagcggaacatggtgcgtatcgacatgaccgagtatatggagaagttcagcgtcagccgcctgatcggcgcgcctccgggatacgtcggttatgaagagggcggccagctgaccgaggccgtccgccgcaaaccctacagcgtcgtgctgttcgatgaggtggaaaaggctcaccccgacgtcttcaacatcctgctgcaggtgctggacgatggccgcatcaccgacagtcagggccgcacggtggacttcaagaacaccgtcatcatcctgacctccaacctcggcagtgacatcatcctgaacgacctggagcagcgccgcgccgagggctccaacgagctgagtgaggatgcccgcaagcagatcgatctgctgctgaagagcaaattccgtcccgagttcctgaaccgtctggacgagatcgtctactacaagagcctcaccaaggacgagacccgcaagatcgtggacctgcagctcgaagatctgcgcaagcggatggacgagggcaagcacctcaagctggacgtcaccacggcagccaaggacttcatcattgattcctcttatgacagcgtctacggcgcacgtcccatcaagcggttcatccagagccgtgtggagacactcatcgcaaaggccatcattcagggcagctacaccgagggcgcgaccctgacggtggactacgacggcacgggccttgtgctccgctaa

SEQ ID NO: 2365 - DNA, 2406 bp, Unknown
  Artificiall/Consensus sequence
atggacgattcaaaaaatcagaccggaaatgcccggctgctcaatatgccggggcggcgggaccagatgctccgcaccatgctgctctgtgcgctgacggcggcgatattcttcctgccgttctatatcatcgacggtggatttttccactacgcgggcgatttcaacagccagcagatcagcttctaccgctacatgaacggcttcatcaagggggcaggctacccggacggtatggccggcgcggcccgcagcaccttctcctgggccaccgacctgggcagcggcgcgatgaacgcctactcgttctacctgtatggttcgccgttcttctggctgtccctcatcttcccccagaactggctgccctacctcatggtgccgctgctggtgctgaaatttgccgtggcgggcggcggcgcttaccgctacctctgccgctatgtccgccgctccgatcacgcggtgctgggcgcctgcctgtatgccttctcgggtttcagcatctacaatgtcttcttcaaccactttatcgacgtggtggccctcttcccgtggatgctctgggcgctggacgaaacgctctacgagcaggaagagcactacggcctcttcgcgttctgggtgggggtcaacctgctcaacaactacttcttcttcatcggacaggtcctcttcctcgtcatctacttcatctgcaagctgacgacgaaagatttcccgatgaatgtccgactcttcgtccggctggcgtttgagagcctgctgggcgcggctctgggcttcgtcctgctctggccggcggtactcagcattttgcagaacccccgcaccatcgacctgtcgtcgggctggggttttctgacctactcgaaggtgcagcagtatctggccatcctgctgagctggatcttaccgcccgattcgccctatatcacctccatctggtcggagggcatcatcaagtggacgagtatgtcggcctatctgcccctgtgcagtctggccggcgcgatggcctactggcgggcccggaagggcgacagcaaaaagcgcatcgtcgccacctgcgccatctttgcgctggtgccggtgctcaacagcgccttctacgccctcaattccagctactacgcccggtggtactacatgccggtgctcatcctctgcgccatgacggccagtgcgctggaaagccccgacatctctgccgacgagctggacgccccggtccggggcatcggctggctgatgatcgcgacgctggcgtttgccttggtgccggtgcaggacagtgataccaaagaatggtcgctgggtgtgctgcagaatcccggccagtatgtcgccgtcctgagcttcggcatcggcggtcttatcctgtaccacctgctctgccgccgctggcgggggagcagggcctttgcccgtcggatgacggcagtggtgctggcctttgcctgcgtgttcagcatggtacacatcggcatcggcaagttcggccagtggcacaccgacagcgaccttgtggagcagtacacctctgccatcaagctcaaggatgacctgcccgagggcgactggcgcgtggatacctacaagacccacgacaacctcggcctctggctcgacaagagcagcctgcaatacttcggcagcacggccgcgcccagcatcctcagcttctacccggcactgggcgtcaagcgggatgtccgcagtgagccggacatctccaactacgccctgcggggtctgctgagcgtcaagtacctcatcaccacgcccgaaaagcaggaagattttctcgccgctgcggacgacggatggagctactacgacaccaaagacggcttcatgctctacgagaacgagaactacgttcccatgggctttacctacgactactatattacggaggagtcctacgagacgaccattaaaaatacccgcgcgaacctcctgatgcgggcgctggtgctcagcgaagaggacgccgaaacctacggcaagtacctcaagaagctgcccgacgcaaagctggacgatctgtggtacgacacctacgtctctgactgcgccgaccgccgcgcctcggcctgcagcaccttccagatgaacaactccggcttccatgcggagatcacgctgaagaaggacaaccttgtcttcttctccgtaccgtacgacgatggattcacggcctacgtcaacggcaaagaggcagatattgtccgggtggacgaggggctgatggccgttctggctccggcgggggagaacaccatcgacttcgtctatcaggccgacggttattccctggccagtaaagtctcgctggcaacgctggcggtattcgtcctatacgccgggtattttgtctggaagaaaaagaaacgctgttga

SEQ ID NO: 2366 - DNA, 816 bp, Unknown
  Artificiall/Consensus sequence
atgctgagagatattaccatcggccagcacttccccggcaacagcctcgtccatcgttttgacccccggctcaagctggtgctgaccatcctgtatatcgtgctgctctttgcggcgtccaacccgctgggccttgcgctttcgctgattttcctcgccgtgatgtacgcggtagcgaaaattcccttcaagctcatcctcaagagcctgaagcccatcttccccatcatcgtctttacggcggtgctgaacctcttctttgtctcgggcgagggcgacccggtgttcaagctcggatttctgaccgtttacgcggagggcatccggtatgctgtactgatggcggtgcgcgtcatggccctcatcgcaggcacgagccttttgacctacaccaccagtcccatcgtcctgacggacgccatcgagcagctgctcaagcctcttggcaggctccacttcccggtgcatgaactggccatgatgatgagcatcgcgctgcggttcattcctaccctcatcgaggagaccgacaagatcatgaacgcccagaaagcccgtggtgcgcagctggacaacggcaagatgaccgagcgcatcaaggcgctggtcccggtgctggtgccgctgttcatctcggctttccgccgcgccgacgagctggccatggctatggagtgccgctgctatcgcggcggcgccggacgcacccgcctcaaggtgctgcggtgcgaaaagcaggattatatcgacctggcagtgtgcattgcgtgttttgcggtgatcctcgcttcgagattggtgttcccgaatttctaa

SEQ ID NO: 2367 - DNA, 3936 bp, Unknown
  Artificiall/Consensus sequence
atggaaaaattcagtgtcaaaaagccgttcaccatccttgttgcggtcatcatggtcctgctgctgggcttcgtgtccatcgcgaacatgcagacgaaccttctgcccgacatcagcacgccatacctcatggtggtcaccgtctaccccggtgccagcccggagcgtgtggagtcagaagtctccgatgtgatggagaacgcgctgggtacagtgtccggcgtcgagagcatcacggcgacctcggcagaaaactacagccttctgctcatgaaattcgccgaaggcaccgacatgaacagcgcgatggtcaagacctccaacaaggtggaccagaccgcgtccagtctgcccagcacctgtctgaccccctccatcatcgagtacagcctgaacatgaacgcctttatgacggtggctgtcagccgggagggcagcgatgtctacgatctgtcggattttgtggataacaccctcgtgccttatgtgggccgcaccagcggcgtttccagtgtgtcggccaacggcctcatcgaaaagatggtgcaggtgcagctgaatcaggataagatagacgaagtgaacgcccgcctgctggaacttatcgacacccagctggccgacgcccgcgcccagctcgatgacgccgaggcccagatcgccgagggccgcgccgagtacgaaaaacagctgaaaaactttggcgacacggtctctgacaccgtcatggcccagatgggtactgaggtggccgacgccgtcaccgtcgtgcgcgaccaggcgcaggctttgctgagcagcatcaaccagctcatcggcgtggtcaatgagccggagatccagcaggccctcatcgacgtccgcgacggcctgcagcgggtcgtggaccagttcaaccagaccggtatgcgggacatcgactccctcatcgagatcgtcggtgagctgcgcgacatcaccgataagctcaccgccgctctgcaggagctgcagggccgtctgggaaccagcgacggcaccgtctccgaccttgccgacgagctggaagtctccaacagcttgagcaccatttataagactctggacgaggtcatcaaagccatggacaatgtccccggcctgatgaaccagttctccgtcgctctgggcaactattccagccagcagctcagtgcctatatgcagttcaccgaggcccgggagaagctgaaggactacgagaaccagctggaagacgccaagcagctctacgaggagaccaaggaaaaggcccttgccagcgccgatgtggccaagcagctggacatcaagaccctcgcccagctcatctacgctcagaacttctcgatgcctgccggctacgtcgccgataagagcggcgagtcctggctgctgaaggtcggcgaagagtacgacagcgtttcggacatcgagggcgcacttctgctccacgtcgatggcttcggcgatgtccgcctctccgatgtggccgacgtggccgtcatcgacaacgccgaggccagctatacccgcctgaacggggagcgggccgtggtgctgaaaattttccgcaacgccaattccagcgccagcagcgtctcggacggctgcctgaatgccttcaaagagctgcaggctcagtattctgaccttcacgtcgtcgtcctgtccaatcagggcaactacatcaccatcatcgtcaacagcatcatcagcagtatgctggtgggcgctgcgctggccatcatcgtgctggccatcttcctgaaggacatcaagcccaccctcgtggtcggcgtcagcatcccgctgtccgtcctgttcgccgtcgttctgatgtacttcaccggcctcgacatgaacatcatgacgctggcaggcctgtcgctgggcgtcggtatgctggtggataactcggtcgtcgtcatcgagaacatctaccgtctgcggggccggggcgtaccggcggcccgcgccgccgtgcagggcgctcgtcaggtgggcatgtcggtcgtggcctccacccttacttcggtctgcgtcttcctgccggtggtgttcgcctccggcacggtgcgcagcctgctgcagcccatgtccatgtgcatcggctactgcctgatggcctctctcatcgtagccatcaccgtcgtgcctgccgctgcttccactgtcctgaaaaaggctgagccgaagcgtctggtctggttcgaaaagatccaggataagtatgcccacagcctcgagtggtgcctgcagcaccgcgctctgccgctgctggccgctgtcgtgctgctggccttctgcggctggaaggtcttctccatgggcgtcgtccttctgcccgaaatttccagcaatgaggccaccatcgccctctccaccgacgacggcctgaccaaagaggaatcctacggtgtggccggacaggtcgtcgaggccgtcatggccgtggacggcgtggaagaggtgggcgtcaccaccgataccactgtggccggcatcgacatcggccagctgggcctgcccagcgctatcaccgacctgctgagcgccgccaacagctacggcagctaccagttcaacgtcatgctggacgagtcactgtcctctacccggatcgccgccgtggagcaggccctgaatgatgccgtttccggcgtcgagaactgcaccggcaccgtcgagatcagcggtatgcaggacctgaccagccagctgagcagcggcctctctgtcaagatctacggccccgacgccgataccattaccgcactgggcgataaggtcgtccagatggtcaacgacaccgagggcttcgccaatgccgccaccggcctcggtcagggcgatgcgaccatcaatctggacatcgaccgcgacaaggtccgcgcctatggcctgacggttgcgcaggtctaccagcagatcgccgccaagctcaccaccaccacgacggcggagacgcccgtcacggtggacggctccactatgaaagtccagatcagcgataatcttgaccctgtgaccaaggaaaacatgatggacatgaccttcaccaccagcgtcatggacgccaccggcaccaccaccaccggcacctgcacgctgggcgatattgcttcctggacgacgggtactgctcccgactccatcaccagcgagaaccagacccgctacatcacggtgacggcagatacgctggacggctacaacaccacggtccagtcccgcgtgctgcagaagacgctggacgccttcgccctcaccgatgagatgcccgagggctgctccttctcgctgggcggcgagtcctccaccgtcaatctgatggtcgacgagatggtgcagtggatggctctggccctgcccttcgtctatctggtcatggtggctcagttccagagcctgctgtcccccttcatcgtcctgttcacggtgccgctggccttcaccggcggcctgctgggtatgctggtcaccggccagcagctgaccatgatctccctgatgggcttcatcgtcctgatgggtaccgtcgtcaacaacggcatcgtcttcgtggactacgccaaccagctgcgtctgggcggtctggagcgccgtgcggcccttgtcgccaccggcaagacccgtatgcgtcctatcctcatgaccaccctgaccaccgttctggccatgctgcagatggtgttcagcaacgatatggcgagccagctcatgagcggcatggccatcgtcatcatctgcggcctgagctatgccaccctgatgaccctgtacatcgtccccatcctctacgacatcctcttcaagaagccgccgctggtggtcgatgtgggtgacgacggaatggacgacatccccgacgatgccgccgagtatatcgcgcagtcgaatgccgccgcggctcagcccgcccagccggaggcctga

SEQ ID NO: 2368 - DNA, 2088 bp, Unknown
  Artificiall/Consensus sequence
atggcagcaaatgttatggagatctacggcagcaaggtgttcaacgagcacgtcatgaaggagcgcctccccagcgctacctacaagagcctcgagaagaccctgcacaagggcgcacctctggacatcgaggtggcaaacgtcgtggccagcgtcatgaagcgctgggccatggagctgggtgccacccactacacccactggttccagccgctgaccggcattaccagcgagaagcatgacggcttcgtctcccccgtgggcgacggcaccgccatcatggagttcaacggcaaggagctggtgcgcggcgagcccgacgcctcttccttcccctccggcggcctgcgcgccacctgtgaggcccgcggctacaccgcatgggaccccaccagcttcgctttcgtgaaggacgacgtcctctgcatccccactgcattcgtcagctacaccggcgaggcgctggacaagaagactcccctgctgcgctccatgaacgcgctgtccaatcaggccatccgcgtcctgaagctcttcggcaaggacgtggattacgtctccaccaccgtcggccccgagcaggagtacttccttattaagaaggaagactacgaggcccgtcaggacctcatcctcaccggccgcaccctcttcggcgcaccgtctgccaagggtcaggagctggaagagcactacttcggcgtcatccgccccgaggtctccgctttcatgaaggagctggacgaagagctgtggaagctgggcatccccgccaagaccaagcacaacgaagtagctccctgccagcatgagctggcccccatcttcgacaccaccaatgtcgccatcgaccacaacctgctgacgatggagatgatgaagaagctggcccccaagtacggtctggtctgcctgcagcacgagaagcctttcgagggcgtcaacggcagcggcaagcacaacaactggtccatgtccaccacccacgagaatctgctggacccgggcgacacccccatggagaacctgcagttcctggtcttcctcgccgccgtcatcaaggctgtcgatgagtacgccgacctgctccgtacctccgtcgccacccccggcaacgaccaccgtctgggcgccaacgaggcacctccggccatcatctccatcttcgtgggcgaagagctggaagccgtcatcgacgccatcgcttccgattctccctacgccggccccgtcaagatgaagatggacctcggcgtcgatgtcctgcccaagttcagcaaggacaccaccgaccgcaaccgtacttctccctttgccttcaccggcaacaagttcgagttccgtatgcccggttccgccgagaacctgagcgactgcaacaccatcctgaacaccgccgtcgccaaggagctgaagggctacgctgacgagctggagaaggccgacgacttcaccagcgccgccatcgccctcgtcaagcgcactgtccgcgaccaccgccgcgtcatcttcaacggcaacggctacactgccgagtgggaagaggaagcagcaaagcgcggcctgcccaacaagaagaacacccccgccgctctgcccgccctcatcgagccgaagaacatcgccctgatggaggacttcggcgtcctgaccaaggtcgagatggagagccgctacgaagttgagatggagcactactccaagatcatcaacatcgaggccctgaccatgctggagatggcccgcaagcagctgctgcccgccgtcaacgcctacatgagtgaggtcgccaacaccgccgcctccaagctggccgtcagcgagaacctgagcgtccgcagcgagacgaaggcactgacccgcctgtccgccgacgccgacgccatgagcgacgctgtggacgagctgcaggccgccgtcgatgccgcaaaggccctctccgacgagagcacaaaggccgtcgccttccacgacgacgttctgcccaagatggacgccctccgcgccgccgccgacgacgccgagaccatctgcggcgaggactactggcctctgcccagctacagcaagatgctctactacgtctga

SEQ ID NO: 2369 - DNA, 1947 bp, Unknown
  Artificiall/Consensus sequence
atgacacaccatccgagtgctgcgtccctccggctgcacggggcgcggctgctgtttccgcctgtggccacccttctgtttctggtgctcaccgagtacatcgcccgcggcgccctgagcggagatacctttgtgcagtacatcttcccccacgcagaagcctacctgctggcgtgggggctgctcttcctcgtctggatggcggtggactggctcacccgcttcgccccgctggccaccctcctgtcggccctgctgggctgtctgcccgccacggtggacttttacatcctgcagctccggggcgagcccttcctcccgtgggacctgatgcaggtgtccgaggccgccggcgtggcctccgcggcgggcatccacgtccagaagagcatggtcgtctccggcgtcgtggtgctggctctgaccgtcggctccttcttcctctaccgggggcgtcagaagctgccgtgggtgcagcgtctggcgggcttcgcggccagcacagcggccacctgcgccctcatcttcggggtgtttttgcagcctgccgtcacccagtcgctgggcatcctgcccgacgcatggatgcaggaccgctactaccgctattacggcgtcatcaccagcttcctcaccaacctgacgaatctggagatcgacaagcccgaggcttactcggaggaggccatcaacgccatcctcgacaacgtggaggcaggggagaagtacaccaccagcccggtctaccccggctcctacgccgcccagaccccggcagacgaacaggtgaagcagcccaccatcctctacgtgatggacgagtcctactgggacgtctcggagctggaacagtacggcttccagttcgacaccgacgtctcggccaacctccacgctctgcagcagaccagcgcctatggccgggtctacagccccagcttcggcggcggcacctgtgatgtggagttcgaggccctgacgggctactcggtgtcctatctgcccagcggcagcaagccctaccagcagcacgtgacgaaacccatgttcgccctgcccagctacctcaagaccgaagggtatcagacggcggcggtccactgcttctgggccagatactggagccgcgacacggcctaccccaacctcggcctcgacgacttcatcagcctcgagaagatgcacggcgtccagaaggtgcgccgccactactggaccaccggcctcgtcaccgacgactccatggcagaccagatcatcggccagtacgagaccatgaaggcccagtccgatgcccccgtcttcctccacgccgtcaccatgcagaaccataccaattataataaggataactaccccgacgaccagcgggtgaaagtcaccgaagccccggcgggcctcaaggccagcaccgtgggtgcgctggaagactttgccaccggcatccgggacgccgacgccatgctgggcaggctgacggactacttctcgcaggtggacgagccggtcatccttgtgttctggggcgaccactacaatcccatcgactccaattacgacatctacacccgcagcggctatgccagcggctccagcgccgacccccgcctccatcagaccaccctgctgatgtggtcgaactactccgaccgcgcggtggacctcggcaccatcgccgcctacgacatctcgccggtgatgatggagctgttcggcctgcgtcagcccgcctacttccagttccttggccgtcagctccgggccgcctaccgggccaacacccgcggcaccatcctggagaaggacggcaccgcctcgaacgagctgacccctttgcagcagaagtggagcgatgagcactggctgctccagtacgacctcatgttcggcaaaggctatgccctgagccggatgggcctcgggagcatcgccgagggcgcagattga

SEQ ID NO: 2370 - DNA, 1818 bp, Unknown
  Artificiall/Consensus sequence
atgagcaaagtgatcggtattgaccttggcaccacgaacagctgcgtggcagtggtggagggcggtaagcccgtcgtcatcaccaacgcagagggagagcgcaccacccccagcgtggtggcgttcaccaaagacggcgagcgtctggtgggcggcgcggcaaagcgccagcttgccaccaactccggccggacggtgtccagcatcaagcggcatatgggcagcgactaccgcgtccacatcgacggcaaagacctgactccgcaggagatcagcgccatgatactgaccaagatacgccgcgacgccgagagctacctgggtgagccggtgacggaggccgtcatcaccgtccccgcttactttgacgacagccagcgcaaggccacccaggatgcgggccgcatcgcaggcctgaacgtcctgcgcatcatcaatgagcctaccgccgccgctgtggcctacggccttgacaacgaagcgccccagaagatcctggtctacgatctcggcggcggcaccttcgatgtctccatcatcgagatcgaagacggccccttcacggtgctggccaccggcggcgatacccgcctcggcggcgacgactttgaccagcgcatcgtggaatatgccgtggcagagttcaagaaatcggaccgtatcgacctctcccgcgaccccgccgccatgggacgcctgaaagaggaggccgaaaaggccaagaaagagctgtccagcgccctctcggcccagctcaatctgcccttcatcgctgtgggcaaggacggcccccaccacctcgatctgaccatctcccgcccccagttcgagatgatgaccggcgacctgctggcacggacggtggccccggtgcagaatgcactgcgggatgccggcatctcggcttcgcagctgggcaaagtccttctcgtgggcggcagcacccggatgcctgccgtcgagcgtcaggtgaaggagctgctgggctgtgaaccgagccacagcctcaaccccgacgaatgcgtggcgatgggggccgctgtgcagggcggtctgttacagggcggcggcaagctggctggtgcttctggtgcagcggcgcagggccttgtgctgatggacgtcactccgctgaccctctccatcgagacactgggcggcgtggcgacccccctcatcacccgcaacagcatgatccccacccgcaagagccagatattcaccacggcccgccccatgcagaccagtgtggagatcaacgtcctgcagggtgagcggcatttcgcccgcgacaataagagcctcggcaagttcaagctgaacggcatccgggccagcttctcgtccaagccccaaatcgaagtcacctttgatattgacgtcaacggcgtcgtgaaagtctcggccaaagacctcggcaccggccgggagcagaacatcaccatcaccggcagcacgaacctctcggagaatgagatccagcgcgccatggccgacgcggccgcctacgaggccgaggacagccgccgcaaagagcggcttgacctccacaatcaggccgaggtgctggcttataaggtggacgaggccctctccaagtgcaagaaggagctggacaaggaggagaagaaccgcatcaaagccgatgtggcgaacctccgccgctgcctgcggaaggataagcccgagaagatgaacgaaacggaggaagcagacctccgtcaggccaagagccagctcgaagcatccgcaaaccacctgatggtgctctatgcatcggagcagagcgagaacggctcggacggaaccattcgataa

SEQ ID NO: 2371 - DNA, 2907 bp, Unknown
  Artificiall/Consensus sequence
atggcaaagagaaaacgcaagacctccgggcgcagcacagcctcgcgccgcaagaaccggacacaggaccggatgcccgcggggctcatcaccctgtttgcggggctggtgctcatggcgctggctttcgtgccgggcagctcggcctggcgcacgatgcacgatgtcctgttcggtgtgttcggctgcggaagtttcgtgctgggcgcagcgctgtgctatctggccatcctctacacccggggcgaagaccttctgccccatatcgcaaagctggtgctgggtctcatcttcgccagcggcacggtcatcgtcttttctgacatccctaccgaccagaccgccgcgcagatgactgccgcctgttatcataatggtatgagcgcatggctctcgggcggtgcgctgggcgctgtgctgggcgggacgctcctgctgctttgcggcagacccgccgccaatctggtcatggcggcgctggcggcctgcgccagcctgtacatttttgacgttacgcccgccgagtgctggcagtggctctgcaacgtgggcggcagcgtccacgaaaagggccttgccgtccacgagcagaatgccgcccgccgggccgagcgtctggcagaacgtgccgccgaggaggccgaggcggaggaatacgaggcctatgacgacgacctgccggaagacgaagtgggcgaaggtgaggaccactacggcggcgaagagcctgccgcgcccgccttccatatccagcctcccggctggctggctggcgtcttccactggggccatcaggtgatgcagggcggcgaacaggcagagcctgcccctgcgcccgcaccggaagtgcagaccccgcctcagcccgagcctgcccccgtacaggtggaaaagtcccggccccgtgcgccctttgatattgatctgggccctgaccataccaccgtcaccgagggcggcagtgagcccatcgagcccatcatcctcggccccggcggcaccttcggcatggacccgctccgccgtgcgcccatccgcgccaccgtgacgcccattgtcccggacgctgtggataccgccgccgaggacttcttcacggcccagcccgagccgacggtgacgcccaccgttgcgcccgcagccccggcagaagagccggaacagcagcccgcgcctgagccgccgctctccttcggcatcccgctctatgatctgaccccgactccggaaccgaccccgcagccggtcagcgccgagaatgctgtggcgttccgctctgagccggatgaggacggctggatcagcatcaccagcgacccggtggaggaaaaagaccttaatacgctggtggcagccgccatggaaaagcctgctgtctccgaggagcaggccgcgaacgcccccgccgaagaggccgagacggaggagagcttccagtatcagtacccgtccatcgagctgttcgagcgcgccccggaggaaagcgactccggcgcagaagacgagctgaaagccaacgcccagaagctggtggacacgctggaaagtttcggcgtccgcacccgtgtgctggatatttcccgcggcccgtcggtcacccggtatgaagtccagcccatggcgggcgtcaagataagccgcatcacttcgctggcggacgacatcgccctgaacctggcggtggccgatgtccgcatggaggctcccatccccggcaagcctgccgtgggcatcgaggtgccgaaccataagaaaacgccggtctacatccgcagcgtcttcgagagccagagctttttgcggatgacctcgccgatgggcattgcgctgggcaaggacatcgccggcgtggcccaggtggccgacctgtgcaagatgccccatctgctcatcgcgggcagcaccggcagcggtaaatcggtctgcgtcaacagcatcatcatgagcctgctgttccgctccagccccgaggacgtcaagctcctgctcatcgaccccaaggtcgtcgagctggctgagtacaacggcatcccccacctgctgatgcccgtcgtcaccgagccccgcaaggcggctggcgcactgggcggcgcagtgcaggagatggagcgccgctaccacctcttcgcggagaacaacgtccgcgacatcaagtccttcaataagctggctgcaacggacccgaacctcgagaagatgccctatatcgccatcatcatcgacgagctggccgatttgatgatggtcgtcggcaaggatgtcgaagactccatctgccgcatcgcccagaaggcccgcgccgccggtatgcacctcatcgtggcgacccagcgccccagcgtggacgtcatcaccggcctcatcaaggccaacatccccagccgcatcgccttcgccgtgtccagtcaggtggacagccgcaccatcctcgacggtgccggtgccgaaaagctgctgggcatgggcgatatgctcttcatgcccgtaggcgcacccaagcccacccgtatccagggtacctttgtgcgggatgaggagatcagccgtgtgctggacttcatcaagaagagcgccaccgtccagtacgatgaagccatgatagaggcgatggaaaaacacgccattcaggacggcaagaagggcagcagttctgccgactccgacgaggagggcggcagtgacccgatgctcaagcaggccgtggaggtggtcatcgacgccggtcaggcgtccaccagccttttgcagcgccgctgcaagctgggttatgcccgcgccgcccgcatcatggacgagatggaagaaaagggcatcatcggcccctacgaaggtgcaaagccccgcgctgtcctcatcagccgccagcagtggctggaaatgcagatgaatcagccggatgaatcataa

SEQ ID NO: 2372 - DNA, 1443 bp, Unknown
  Artificiall/Consensus sequence
atgattttgatttctgagaaggaaaagttttttgacccccgcaagcccttccagtcggcccggcctgagactcacgaagagtggcaggcccggatgggcggcgaggtgctggccgtggtgcgcagcgggctgtatctggacttccgctttttagaccaggccctctcggccctgacgcccaccgccgacgagcggtgcggtgtgctggcgacggatggaaccatcctctgctaccagcccagcgccctgcttcggctctaccagaagaaccccaaatatctcaaccggctctacctccacacggtgttccactgcatcttccgccatctctggctgcgcggcaagcgggacaaacgcctgtgggaccttgcgtgtgacattgcggtggagaacgtcatcgacggtcttggccgcaagagcgtccggcgccccctgacgtgggtgcgccaacacgcctatgaggagatcatcgcgcaggaaaaagtggctgctgcagcgcccatctaccgctggctggtgcggcagactcccggcgttctccgccagctggaaaaagaattctacaccgacgaccaccgcctctggcccaaagatgcccccgaacagcctcagcagatgcctgcgccgctgccccagaggacgtggcaaaaaatcggcgagcggatgcagacagagctggaactccgggacaaagaggccggtgagggcgcggatgccatgcgggagcagatcaaagccgcaaaccgcagccgccgcagctacggcgacttcctgcgccggttctgcgtcacccgggaggaagtccacctcgacccggatgagttcgatttgaacttttacacctatggcctgtcggtctacggcaacctgcccctcatcgagccgctggagacccgggagagcaagaagatagaagagctggccctcgtcatcgacaccagctactccacctcgggtgagctggtgcgggcctttctggccgagacgtacactctgctgaagggcagggagaatttcttccatcggatgaatctccacctcatccaggccgacaacgcggtgcggcaggatattcccgtcaaaaacgaagacgacctcatccgtgccatgaaccatttcgaactgcggggcggcggcggcaccgatttccggcccgccttcgagtacgtcagccagctctgcgccgagaagaagttctcgaacctccggggtctgctctattttaccgatggtatgggtacttacccggcccgacgcccggcttacgacacggcatttctatttctgggcgaccgcttcgacgacgccaatgtgccgccctgggcgatgaaagtagtgctggacgaagaagaatttaccggtgaggcagcccgcagcgcctcggccctgtccgaagcgctggcggaggaagacgacctctaccgtgacctcaacaattcgtga

SEQ ID NO: 2373 - DNA, 1788 bp, Unknown
  Artificiall/Consensus sequence
atggcacagacaaaagaacagaaccacgctcccgctgcggccaatgcgtccggcgaaaagcgcccccgcacttcccgccggccccactacacccgccggccccgccgcccccagcagcccaaagaggctgcaacgcccatccatatctatccgctgggcggcctcggcgaagtgggcaagaatatgacggtctatgagtgctgcggcgatatgatcatcgtggactgcggcctcgtcttcccggataacgatatgttcggcgtcgatatggtcatccccgacttcacctttgtggtgcagaataaggataagatcaagggcctgctcatcacccacggccatgaggaccacatcggcagcatcccctacctgctgcagaagttcgatctgcccatctacggcacccgcctgacctgcggcctcatccgcaacaagctggaagagttcggccttgcaggcaagaccaagttcgtggagatcaccccccgccagaagctcaagctgggctgcttcaccgtggagcccatccatgtgaaccactccatcccggacgcggtggctttcgccatcgacagcccggccggcaccatcatccagaccggcgacttcaagatcgactacaccccgctggcctgcggccccaccgaccttgccactctgtctgagtacggccagaagggcgtgctggctctgctgagcgactccaccaacgcggagcgtcccggcttcaccgccaccgagcagaaggtggccgacggtgtccgcagcctgtttgcccgggcgcagaacaagcgcatcattattgcgaccttcgcgtccaacatctaccgtgtccagcagatcatcgacctcgccgtggaggatggccgcaaggtggccttcagcggacgcagcatggtcaacaataccgccatggctcaggagctgggctatatgcacatcccggaaggcaccctcatcagcatcgatgagatcaaccagtatccgccggaacaggtggtgctggtgaccaccggcagtcagggcgagcctctgagcgccctgagccggatggcttcctgcagccaccgtcaggtgcgcgtcggccccggcgacttcatcatcatctcggccaagcccatccccggcaacgagaagagcgtgaccaagatcgtcaacggtctgctcctgctgggcgcagaggtcatctatgagggcatgtacgacgtccacgtctccggccacgcctgtcaggaagagcagaagctgatgctcaccctgaccagacccaaatatttcctgcccgtccacggcgaatataagcagctgaaaaagcacgccatcacggcggcaagcctcggcatccccaccagcaacatcctcattgccgagaacggctccaacatcatcctcagtcaggacgagatgaagctgggcgagccggtgacggcgggcgctgtcatggtggacggcctcggcgtgggcgatgtgggcaacgtcgtcctgcgggaccgcaagcatctgtctgaggacggcctcgtcatcatcgtggccaccgtggacagcaagaccggcaaagttctggccggccccgacctcgtgagccgcggcttcgtctatgtgcgggagaacgagagcctgatggacggcgcccagagcatcgtggagacggctcttgaccgctgcgtggacgagcacgtccgcgactggaacagcgtcaagacccgggtgcgcgaggccctgagcagctatatctaccgccgcaccaagcgcagccccatgatcctccccatcctgatggaggtctga

SEQ ID NO: 2374 - DNA, 2301 bp, Unknown
  Artificiall/Consensus sequence
atgaacacagtcaacaaacccttccgcaagaaggatgccatgcagctggtgacgggtcagcccgtctatatggacgacctcgtccccgccgactgcctcatcgtgaagctcctgcgctctccccacgccaacgccatcgtgaagagcatcaatacggctgtggcgaagaaggtgccgggcattgaggccatcttcacctgggaggacgtgccgcaggatgcccgccgctacacccaggccggccagacttaccccgaggccagcccctatgaccgccttctcatcgaccgccacgtacgctttgtgggcgacgtggtggccatcgtggcaggcaaagacgataaatgcgtcgataaggcgctgaaaatgataaaggtcgagtatgaggtgctggaacctgtgctcgactaccacaccgcaaaggataaccccatcctcgtccatccggaagacaactgggagagcctctgccctgtggggggcgataacaagcgcaacctctgcgcccacgacgagtgcggcagcggcgacatcgacgccgtgctggccgactgcgatgtggtcatcgaccatgtctaccataccaaagcctgtcagcaggccatgatggagaccttccgcacctattgcagcatcgacctctatggccggctgaacgtcttgagctcgactcaaatcgtcttccacgcccgccgcatcattgcaaacgcgcttcacatcccgaagtccatggtgcgtgtgacgaagccccgcatcggcggcggcttcggcgcgaagcagacggctgtctgcgaggtctacccggccttcgtgacctggaagaccaggaagccctcaaagctcatcttcacccgggaggagagccaaatcgcctccacgccccgccatgagatggagatccatcttcgcctcggcgccaacaaggatggccgcatccggggcctcgacctctacaccctctccaacaccggcgcttatggcgagcacggccccacgacggtgggcctttcgggacataaatccatcccgctctatagcaacgctgaggctttccgctttacctatgatgtggtctataccaaccatatgtcggcgggcgcataccgcggctacggcgcgacccagggcctgtttgcggtggaatccgctgtcaacgagctggccgcgaagctccatatggaccccttcaaaatcagggaaatgaacatcgtccacgagggtgacgtcatgcccgcctactacggtgcggtgaacaccagctgcaccctcgaccggtgccttgcaaaggtccacgagatgataaactgggacgaaaagtacccccgccgagacatgggcaacgggaagatccgtgccgtcggcatgggcatggcgatgcagggctccggcatctcgggcatggacgtgggcagcgcgaccctgaaaatcaacgacgagggtttctacaccctgctcatcggtgccgctgatatgggtaccggctgcgacaccacgctggcccaaattgctgccgaggtgctggaatgcggcctcgacaatatcacggtcttcggtgcggacaccgacacctcgccctacgattccggctcctacgcgtccagcaccacctacatcaccggcaaagccgtcgagaagtgcgcgctgaagctgcggagccagatctgcaagctgggtgcacagctgctggattgcagcgaaaatgacgtggaatttgacggtaaaacggtatttacctcggctgacccgtctaaatctgtctcgctgggtgatattgccacggcttccatgttcggccacgacatcccgctggaagtcaccgagacccacatgtcgcctctgtcgcctccgccctacatggtgggcgcggccgaggtggaggtggacaccgagaccggcgaagtgaaactgctggaatttgacgcctgcgtggactgcggcacccccatcaacccgaacctcacccgggtgcaggccgagggcggcattttacagggcatcggcatgaccctcaccgagaacgtcacctacgaccagcgcggctggcccatggagaattcgctcatgcagtataagatccccacccgtgtggacgtgggcaaggttcgggtcgagttcgagaacagctatgagcccaacggcccgtttggtgcgaaatccatcggcgaagtggtcatcaacacgccgcttcccgccatctcggacgccatctacaacgccatcggcacccgtttctacgagctgcccatcacgcccgaaaaaatcgcaatggcagtggccgaaaaagagggtgcggtcggatga

SEQ ID NO: 2375 - DNA, 996 bp, Unknown
  Artificiall/Consensus sequence
atgaaatacgcattgttttcggtgccggcaggcaccatttacgacctgccccagaccatcaaagagggcgaggagggtcttgtctccaccatcggagatgagggcctgtatgggcaggcctgtcaggtgcggactgcgcccggcggcgtgaccgctgcgggcgtccagcttccgcccgatgtggccgaagtggtcagcttttacggttaccatggctatgtgaatcagcgggaattgcagtttgtccgcgaggaggagctgtgggagtatctgggggcagacctcgttctcgtgggccgcgctacggatgtcctcagcctgcccaaggtgcagggcgtccggatgatggaactggagcggggaggcgttctccgccgccagcctgagacggccgaagaggccgaggcccacaagggctgggcgaaagtcctgctgacggatggccggacgggctatgtccgggatgtggcgctggagccggtgaaatatgagatgacggcggtcttctcccagagagagggccttgccttcaatgacgcgctggccgagacgctggacacgacggcagacaagctcgtgccggaagctgtggcacgctggtacggcggcagcgaagatgccttccgcgccgctgtctgtgagcaggcaaagaagtatatgggtaccgagtaccgctggggcggcaagtcgggccggggcatcgactgctcgggccttgtcagcagcgcctatatgcagtgtggtgtgctcatctaccgcgacgcaaagatcatcgagggctggccgatgcatgaggtggccttcgagaacaaaaagcccggcgatgctctcttcttccccggccatgtggcgctttatctgggcgaagggcggtatatccactccaccggtgccgccgccagcggcggtgtggtcatcaacagccttgagccgagcgacccgctgtatcgggaggatctggtgaagtgtttgtatgcggtggggagcgtgttctga

SEQ ID NO: 2376 - DNA, 2334 bp, Unknown
  Artificiall/Consensus sequence
atgaaaactaaaggcaaagcatggcaacttgtcctcactgtgcttttgatcgcggcgttcgtctatacggcattctttggcgtcgcagtcaagtacggtgatgtgaccaccacctacatcaagggcgcgaaagacatccgcttcggtgtggacatcaagggcggcgtcaacgtcaccttcgtcccctctgacggctacgacgccaccgacgaccagctcgaggcagctcagctggtcatcgagaaccgtctggtcgccctcaacgtgaccgactatgagctgtatgtggacaataactccgacagcctcatcctcgagttcccgtggcagtcgggcgagacggagttcgaccccgaagccgccattgaggagatcggcaccaccgcctatctgaccttccgcgaggggagcagtgcagacggtgagctcgtcctcgacggctcgatggtggagagcgcagctgcccagtatggccccgtcaacggcagcagctccgagtactatgtagcgctcaagtttaccgatgagggcgccaaggcattcggcgacgcgaccacccgcctgtatcagaccggcggcaccatcagcatctggctggatgacgagaatgtcagcaccgccagcgtcaacgccgccatcaccgacggctctgccatcatcaccagttctgcgtcgaaccccttcacgcaggaggacgtcgtcaagatggcccgccagatcaactccggctctctgccctttgcgctgacggtggacagctactccaccatcagcccgagtctgggcgagaacagcctgagcgccatggtgctggccggagtcatcgccttcgccctcatcgtggtgctgatgacggctctgtaccgtctgcccggcttcctggcctgcatcgctctggctggtcaggtggcggctacgctggccttcgtctccggttacttcccagtgtttgagagcttcaccctgaccctgcccggcatcgccggcatcatccttgccatcggcatgggcgttgacgccaacgtcatcactgccgagcgcatcaaggaagagctgcgcagcggcaagagcctcgacggcgctctcaagagcggcttcgcccgcggcctgactcccatcatcgacggcaacgtgaccatcgtcatcgtcgccatcgtgctgatgggtgccttcggcccgtctgacggcttcttcgccaaggccctgcacttcgtcttcttcgccttcggcccctcgaccgcaggcaccatctacgccttcggttacacgctgctcaccggtgtgctgctcaacttcgtgttcggtatcttcgccacccgtaccatgatccggggcgctgccgctatcaaggctctgcgtgacccccgcctctacggtgccgatgctcccggcaagatcccggcagagaagaagcaggtcaacttcgttggcctgcgcaagcgcttcctgaccttctccgcctgcctgatggcagctatcgtcctctgcgctgtggtgctgggcgtccatctggacaccgagttcaccggcggtgcgatgatcaccctgagctacgagaacagctttgagatgtctgccgtccagaagaccgcctccgaagcgctgggcagcaacggcctgaccctgcagaccggcgagaacgtcgcgacaggggagcagaccctgaaaatttcgatgcccggcaccgagactgtcaccaccgacgaagtgcagaccctgctggactccctgaatgagagctacccggataactcctttgcacagctctctctgagcaatgtcagcgccgcaatgggtaccaaattcctccagaagagtctggtggccgtggtgttcgcactggtgctcatcctcgcctacatcgcctaccgcttcaagaatatcggcggcctcaccggcggcatgatggctgttctggccctgctcaatgacctgatggtggtgttcggcaccttcgtgctgctgcgcgccccgctggacggcaacttcatcgccgccatgctcaccatcctcggctactccatcaacgataccgtcgtcgtctacgaccgtatccgtgagaaccgcggcctgctgggcaagaaggccagcttcgaagagctggtcaaccattccgtcaaccagtctgcccgccgcacgatcatcaccaccgtcaccacggtgatggctctgggtgtgatgtgcatcgtctccaagctgtacggtctggacagcatcttcacctttgccttccccctgatgatgggtatgctcagcggcgtgtacacttcgctgtgtgtctccacttccgcatgggtggcttggagcgaacgcaaaaacgcaaagaaaaactga

SEQ ID NO: 2377 - DNA, 4176 bp, Unknown
  Artificiall/Consensus sequence
atgtccaagaagatcccatttttacaaatgtttgctgccctgtgccagtggcaggagttggcggaggccgtagagggctgggtcattgtggccgcggccattgacaaggccagccggagcgccctggtgaccctggatggggccaggggagccggggccaatctgatccgccaggcagaggaggccgtggcccggtgctacgggctcgcctcagtgaagtttcagatggcggccccggagccggagacccccgccgaagcgccggcaccggcggctccttctgtgcctgcctccgcaccccagacccgcccggcccatcctcggcagggggagagcacggcaccggagatggacgccttcgcgcggacggaggccattcggcgggaggcgctgcggaaggcccgggggagcgcgccggcggccagacccaagggaaaaggggagggcaagccctccggcaagacgattttcgggcatgtcatcaagaagcggcccacccccatcggggagctggagctggacatgggcatggtggtcatcgagggcgatgtctttgccgtggacaaccgggagctgaaaaagcggggcgcctgggtggtggccttcgatctgaccgactacaccggctccattcgggtgaacaaattcttccccggagacgagggcaagcccatcgtggacggggtcaagaaggggatgcacctccagatccagggccggctgaacatggaccggttctacggcgacatggtgctggagcccatgtccatcatggcggtgcccaagcctatgaagatggatgacgcgccggaaaagcgggtggagctccacctgcacaccaccatgtccgctatggacgccctcacctcggtcggtcccaagctggggccggacaaaaacgtggtcaagcgggcggaggcctggggccaccgggccatcgccatcaccgatcacggggtggcccagtccttcccggatgcgtggcactccgccaaaaatatcaagatcctgtacggcgtggaggcgtactacatcaacgacgtggatgacagagtagtggtccacggggaaacagaacagccctttgaccaggagatcgtctgcttcgacatcgagaccacagggctgaaccggaagtacgaggtcatcatcgagatcggcgccgtagtgctgaaaaacggggagatcaccgaccgcttcaacacctttgtctcccccggccgcatcctgagtccggagatcatccgcctgaccggtatcaccgatgagatgctggtgggggccccctcccaggaggaggccctgcgggctttcctggcttttgccggggaccggcccctggcggcccacaacgccgacttcgacatgggctttatcgccgccggctgccggaaatacggcattcccttccacaatccctccatcgacagcctgatcctggcccagaacctgctgcctgacctgggcaagtacaagctggacatcgtggcggagcacctgcacctgcccgccttcaatcaccaccgggccagcgacgacgcggccacggtgggctacatgctgcccccgttctttaagatgctggaggagatgggcctgcgccacctgggggagatcaacggggccatggtccacctgcgcaagggaggaaaggccaagcgccagcccaagcacctgatcgtgctggcgcggaaccagaccggtctgcgtaacctgtacaagctcatctccctgggacatctggactacttcaagcgttaccccatcatgctcaaaagcgtcatcaacgagaaccgggaggggctgatcctgggctccgcctgcgaggcgggcgagctcttccgggcggtggcggacggcaaggactgggaggagctcaagcgcatcgcctcctggtacgattatctggagatccagcccctgtgcaacaatatgttcatgctccgcaaggggatggtccgcacagaggaggagctgcgggacttcaaccgggccatcgtggccctggggaaggagctgggcaagccggtgtgcgccaccggcgacgtccacttcctggacccggaggacgagatataccgccacatccttctggcctccaagggctttgaggacgcggacgagcccctgcccatctacttcaagaccaccaccgagatgctggaggaattttcctatctggggaaggagaccgcctacgacgtggtggtgaggaataccaatctcatcgcggactggtgcgagcccattgagcccctgcccaaaggactgtttgcccccaagcttgaggactccgacggggagctgaagcggctggtatggggcaaggcccatgagctctacggcgaggagccgccccagatcgtggtggaccgcatcaacgtggagctgggggatatcatccgctgcaagtacgacgtgatctacatgtccgcccagaagctggtgcagaactccctggagcacggctatctggtgggctcccgtggatcggtgggctcctctctggtggcattcatgtcgggcatcactgaggtcaactccctgcccgcccactaccgctgccccaagtgcaagcactcggactttgactacgcccaggacaccgcccacccctacgggtgcggggcggatatgcccgatatgaactgtcccgtctgcggcacgccctatgtgaaggacggcttcaacatccccttcgagacctttctgggcttcgggggagacaaggtgcccgatatcgacctgaacttctccggcgagtaccagtccagcgcccaccggtacacctttgagctgtttggacagacccacgtgttccgggccgggaccattggtacggtggcggaaaagacggctttcggctatgtgaagaagtacctggaggagcgggggaggacggcctccaaggcggaggagaaccgcctggccatcggctgcaccggcgtcaagcgcaccaccggccagcaccccggcggcatggtggtcatcccccaggacaaggagatctatgacttctgtcccgtacagcacccggcggacgaccccaataccgatatcgtcaccacccacttcgaatatcactccatggagtccaacctgctgaagctggacatgctgggacacgatgaccccactatgatccgaatgcttcaggacctgactggggtggacccccagaagatcccactggatgacccggagaccatgtctatcttccagtcctccaaggtgctgggctatgagaacgacaagatcctggggcccaccggcggcactgccatcccggagttcggcacctccttcgtccgggggatgctggaggacacccagcccaaccagttcgatatcctggtccgcctgtccggcttctcccacggaaccgacgtgtggctgggcaacgccaaggacctgatcacctcgggcaccgccaaggtcagcgaggccatcggttgccgggacgacatcatgctgttcctgatctccaaggggatggaccccaagcgctccttcaagatcatggaggcggtgcggaagggccgcggcctgccggagggggcggaggaggagatgaaggagcacggggtgcctgactggtacatcggctcctgcaagaagatcgcctatctgttccccaaggcccatgcggtggcctatgtgatgatggccttccgcatcgcctggttcaaggtccaccggcctctggccttttacgccgcctacttctccatccgggccaaggcatttgaccaggagttcatgtgccaggggatggatgtgtgccagaagaagatgagggagatcatcgccaaggacaaggacgcctccgcggtggagcaggacatgcttaccaccctggaggtgtgctatgagttctatctgcgtggattcaccttccgaaggatggacctgtacctgtcggacgccctccacttccgggtggacgaggaacacaaggcgctgatcccgcccttcatctcggtggcggggctgggggaaacggcggccctgtctctggcggagcaggctaagggacggaggttcatctctgtggaggaggtctccgctgcctgccccaaggtctccaagacccacatcgacaagctgacggaggcgggggctttcggagatatgccggccaccagccagctggacctgttcgccatgctggggtga

SEQ ID NO: 2378 - DNA, 4800 bp, Unknown
  Artificiall/Consensus sequence
atgcatgagaagctgatccgagagatcaacggggagatcgccgacgcgctgctggcgcggaagatgccctttgcccccagccggaaggcggcgctggccctgctgaaggtgccgggatggacggaggggctggagcagatgctgcccatccgggggcggctggagtgcgcccatgtgctggagctgtgctcctgtgtactgccccggctcgccccccggccggaggaggggtggctggccttctgcacccagtacgcccgggagcggatgtaccccggtcaaggcttcgcccctgatcgggaggagtatgaggcgggggccctgtttttcctcaccgtcctccaggtgatgctggaccgggagcggagggcggtgcccttcgaccccctgaaggacttccagttcctctcctcagaggaaatgggggaatatgagtgcggggaggagtaccgccgcttcctggccgccttccgggaggagtacgtctatgagatgatgcggctgagcgaggagaccacccccttccgcaccctggggcacatcgcgggggtgcattacatcgccatgaccgtggcccggggcatccgggaggcgggggagaacgtagacctggcgctggtgtccgctgccgccgccgcccacgacctgggcaagttcggctgccggcccggggagcgtgtcccgctcctccactactactacaccgaccagtggctgctggggcgggggatgcccgccgtcagccacatcgctgccaaccactccacctgggacctggagctggacaccctctccatggagtccctgtgtctgatctacgccgacttccgcagcaagcagggacgggatgagcaggggcgggagaccaccatcctctatcccctggaggagtccttccacatcatcctgaggaagctggagaatgtggaccaggcaaagcgccgccggtatgagttcgtctacggcaagctccacgatttcgaggactacatgcgctctctgggggtggacgtagacctgaccgggcagccgggggcgcggaagccccccaaggacccggccctgatgcccccggacgagacggtggacagcctgatcctgctgtcggtagagcacaacctgaagctgatgcaccagctgagcagcgagcggaagttcggcaacatcatcgaggccgcccgctcggccaagagctggcagcagctgcgggcctatctggatgtgttcgacgagtactgcacctatctgtccgtgcggcagaagacccaggccctggccttcctctatgagctgctgatccaccgggagggggatatccggcgccaggcagccagcctcatcggaaagatcatcgccaaattccacctggtctaccgcaaggaggtgcctgccgacgcccgcactgacccggcggaggaggtgcccttcaccctgtgggaggagtatctggacaagctcatctaccccgaccacaagaccaccccccagcagcggggccagatcggctataccctgaagctggtggtggacgccctgctggagtacggccggagcgagaccatgccccgcttcatcggggcgctgctgcgctactatgaccggccggaggagaaggacgaggataccgccttcaccctgctggacgccatccgctatctgcccgcccagcaatatgaccaggagacccggggcggcctcatccgctttgcggcctggttcgccgcctccggcaacctgcgcctccaggcggcggccctccagttcctgcgggaggcccagcgctccctgccccaggatcacccccagatggctcagatcgcggcggccgcccggtctgccgccggcgggagcctgccgctgctcttcctgcggtataaggtcctccagcgggcgggggaggacgtgtccgactatcaggcggccctgtatgagcaggacgtgaccagcgagatcttcctggacaacctgaagagcgccacacactggatcatcaaggtggtgggcatcgagctgctccaggaccaggtggagcacggcctgcgggagcacatgctccacatcgccacccacttctccaacctggtgaaggtgtccgagcgggtgggcgtccgccacgccgccggcgaggccctggtccgcctgatccccctgctgcgccgggagcagcgcaacgaggtggtggtggagctgggcaagggcctggagatgggccagtaccagatctccaagtatatcccggagtatctgggccgggctgccctgtccctccaccccagcgagctggacgagcaggtgctgtggctgaagaacctgctgggctcccccaccaacatcgccgtgtccggggcgctgaataccgtgggggtgctgctccagcactaccccgcctaccgggggcgcttccctgagccggagcgggcctatgaggcccgccgccaggagctgctgggcctgctgctccaggggctggcccactaccgggaggaggtgcggcaggaggcccttctggtcaccgggaccatgctcttcgacagcccggtgctctccatggaggagaagtcccgcctgttctccctgtgctaccgcaagctcctcttcctcatccaggcgggcccccgtcaggacccgctgaccttcttctaccgggcttccgccctggcccacatcaaccgcttcatcgccctgcggcggttggacaaggggcccttcgccttctcccagccccggaagatcgcctttttccccggcacctttgaccccttcaccctgtcccacaagggcatcgcccacgccattcgggagatgggcttcgaggtgtatctggcggtggacgagttctcctggtccaaaaagccccagccccacatgatccgccggcagatcgtcaacctgtccatcgccggggacttccacatccacctgtttcccaacgatatcccggtgaacctgtccaaccccagggacctgcgccgcctgcgggagctcttccccggccaggaggtctatctggtggtgggcagcgatgtggtgggccacgccagcgcctatcaggccgcccctgtggactggtcggtccactccatggaccacatcatcttccgcagggcgggccagccccccctgccggagggaaaggagctgggcatcaccggaaaagtgatccagctccagctgcccccccacctggaggacatcagctctacccgtatccgggagaacgtggacatgaaccgggacatctccaccttcatcgacccggtgatccaggacttcatctatcagaacggcctgtacctccgcgacacccaggacaagcccctgctcaacgcccgggacctgtccttccagtgggtggagcggccggaccccctgctggtggccgatgtcactgctgggcaccgggagcgggagagcctgcggaccgctatcctccgggacggggaccagctgctggtgctgcgccaccgtcgggagggcggggagcccatgctgggttggctcagcttccgctatctgtctacagccgacctctactccgcgtttcaaaacgccgatctggcggaccaggtgcgcctgcgggcgggaggtaaaactttgttcatcaccggcctggccgccgaagaggagcaggagaaggactatgcccagctgctggtcagtgaggtgctctcccacgccctggaggcggagtgcgtctacgctgtcttccacccccacgaggggctgtgccccccggagacagaggagctcttccggcggcagggcttcatccgccgggatggggggccgctggaggccgatctgcgggccccggtggtgctgctccagaatttggagaccaccattcaggagcccctgagccgcaaccctagggtgctcgccgccatccggcggggacaccagcggctcgagaccgccctcaccggcctgtatccaggcaacctggtcctcaccctgtctgccgacgtgatccaccaccggctgctgcggatgatcacccagttcaaccaggtgccccaggagcccaccaccccccggaagctggggaaatatatgtgcgtccccttcggtaagctgctccggggcaagactgtgcccaacacggtcaccaagaccatccacaccgaccgggtgtactcccctgacctcagcgagagcaccatcgaggcatttcccaactacgcctccatcccctgccaggtgcgcaccatcaaatcctttgaccggcccgtcatcctggtggacgacctgatgcaccccggggtgcgcatcaaggccctggaccccgtcctgcgccaggagggggtggacatccagcttgtcctggtgggcatcctctccggctacggccgggacctgatgagtcagcagaagcggccggtagacagcgtgtacttcctgccctctctgcggcagtggttcgtggaggccaccctgtaccccttcatcgggggcaacacagtgcgccgctcccggcccccagtccccggcctgctgccgggaatcaaccacatcctgccctatgccgtccctcccttcgccaaagagtgcggggaggaggccgtcttccaactctcccgctgctgcctggagtccgcccgggatgtgatcggcaccctggagcgggagtaccgggcactctacggccggaatctgactctgggccggctggctgaggcggtcatcctgcccctgtgtcccgacaagggcacctgcctgggttatgaccccaacttggccgcgtcggtctatctggagaacgacctggagcagctgctgaggacccacccccggggctga

SEQ ID NO: 2379 - DNA, 2808 bp, Unknown
  Artificiall/Consensus sequence
atggactacaacaagaccatcaatctccccaagactgacttccccatgcgggccggtctgcccaaccgggagcccgggatgctccagcgctggaacgacatggacctgtaccacgagctgctgaagaagaatgagggcaaaccccgcttcgccctccatgacggccctcccttctccaacggcaatctgcacatgggccacgccctgaacaagtccatcaaagacttcatcacccgcatgtacgccatgcggggccgctataccccctacatccccggctgggataaccacggcatgcccatcgagtccgccatcatcaaggagcagaagctcaaccgcaagaagatgagcgtggcagagttccgcaccgcctgccacaactacgcccagaaatacatcgacatccagatggagggcttcaagcgcatgggtgtgctgggggactgggagcacccctataagactatggaccccggctttgaggcggaggaggtcaaggtcttcggctccatgtaccgcaagggctacatctacaaggggcttaagcccgtgtactggtgcccccacgacgagaccgccctggccgaggcggagatcgagtaccaggacgacccctgcaccactgtctatgtgaagttccgggtaaaggacgatctgggccgtctgagccaatatggcgacctgtccaacatgtacttcgtcatctggaccactaccatttggaccctgcccggcaacctggcgatcgccgttcacccccgggagagctatgtgctggtcaaggcggacaatggagagctctacatcgtggccgaggccctgtgcgccaaggtgatgcaggcgggcggctttgaccactatgagatcgttaagcagttccgcggccaggacttcgagtatatgaaggcccagcaccccttcctggataaggaatccctgctgtgctgcgccgagtatgtcaccatggattccggcaccggctgcgtccacaccgcccccggcttcggcgccgatgactacgagacctgcaagcgctacaaggtggagctggtggtccctgtggatgaccagggccgccacactgactacgcgggcaagtacgccggcctgaagacggaggagtccaacccggtcatccttaccgacctgaaggagagcggagccctcttcgccagtgaggagatcgttcactcctatccccactgctggcgctgcaaaaaacccatcatcttccgggccaccccccagtggttctgttccgtggactccttcaaggacgaggcggtggccgcctgcgacgatgttcggtggctccctgcctggggcaaggaccggatgatctccatgatccgggagcgggccgactggtgcatcagccgccagcgccgctggggcctgcccatcccggtgttctactgtgccgactgcggcaagcccatcgtcaccgacgagaccattgaggctgtgagcaggctcttcggtgagaagggctccaacgcctggtatgagatggaggccaaggatatcctgccagaggacttcgcctgcccccactgcggctcaaggacgggcttcaccaaggaggaggacaccctggacggctggttcgactccggctccacccacttcgcctccatgcagaaggaccagaatttctggcccgccgacatgtatatggagggtctggaccagtaccgcggctggttccagtcctccctgctcaccgccgtgggcgcgctgggcaagggggctcccttccaggagtgcgtcacccacggctggaccgtggacggcgagggcaaggctatgcacaagtccctgggcaacggcgtagaccccgcggagatctttaagaagtatggtgccgacctgctccggctgtgggcgggttctgccgactaccatgtggacgtgcgctgttcggacaacatctttaagcagctcagccagaactatctgaagttccgcaataccgcccggtactgcctgggcaacctggacggctttgaccccgatcacctggtgtccccggaggagatgctggagctggaccgctgggcggtgaccaagctcaacgagctgatccgaaagtgctttgccgcctacgacaactacgagttccatgtggtctcccacgccatcaacgacttctgtgtggtggagctcagctccttctatctggacatcatcaaggaccgtctgtactgtgagggagtggacagcctggagcgccgctccgctcagaccgctctgtggatgatcctggacaccattactaagctgttcgcccccatcctggccttcacctgcgacgagatctggcaggccatgcctcaccgggagggtgacgacccccgcaatgtggttctcaatgagatgaaccagcccttccaggactacgacatgggcgcgttggtctcctggactgctctgatccagctgcgggacggggtgaacgccgccctggaggccgcgcggaacgagaagaagatcggcaagagcctggaggcccacatcactctggtgcgggcccaggaccaggcggacaacctgaccgcccttcaggagaagttccaggaccagtgggccgacctgttcatcgtctccgacgtggaggtgtcggacgacccggctctgtatgcccaggggagcgacacccccatcgccggtgtgcgggtactggtgagcgaggccaatggagacaagtgcgagcgctgctggaagcaccaccccctggtgggtgccaatgcggcccatcccaccctgtgcccccggtgcgccaaggtggtccaggccatccatctgtga

SEQ ID NO: 2380 - DNA, 1437 bp, Unknown
  Artificiall/Consensus sequence
atggcgaaagaagtcactcctgagcagatcgaaatgctggacgggatggtcgctaaggcccgcgctgcggcggagatcatcgccacctatgaccaggagcgcgtggaccggctgtgccaggcggtcgccgcttctgtgatcgacatgaaggtttgggcgaacctggctgacgaggcggtggacgagaccggcctgggcgacaaggtgaccaagcggaacaagcggaacaagctgaagctgatcctgcgggactgcctgcgtcagaagagcgtgggcgtgatcgaggagatccctgagaagggcatcgtgaagtatgccaagcctgtgggcgtgatcgcgtctctggtgcccaccaccaacccctgcctgacccctgccggccaggtgatctatgccatcaaggcccgtgacgtcatcatctgcagcccccatccgcgcgcgaagaagaccaccaacaagtgcatcaacatcatccgtgagaccctggtgcgtgagggcgctcccgccgacatcatccagggcatcgaggagcccagcatcaccctgacccaggagctgatgaagcgctgcgacctggtcatcgccaccggtggccgtcccatggtcaagtccgcatactcctccggtgtgccggcctacggctccggcgccggcaacgcgactgtcatcatcgacaacacctgcaacacccccgagcgtcaggctgaggctgccatgaacacccggatctccaagtgctccgacttcggctccggctgctcctgcgacggcaacctgatcatccacgaggacgtgtacgacgggttcgtagccgccctggtgaaggagggcgcttacctggccaacgaggaagaggctgagaagctgaaggccgtcatgtgggacgaggcggggcaccgtctgcccaacaccgtggccatcagcccgcagaagctggcggaggccgctgggttcgagatcccggctgaccggaagttcatcgctgtgaccggcggcggcatcgagaacgtgggcaaggagcacttcttctccagcgagaagctgaccactctgctgaccctgttcaagtactacggggagtttgagaacgcactgaccatgatgcaggccatgttcaacgtgggcggcaagggccacagctgcggcatctactccttcgacgacgaccacatccatcgtctgggcatgtgcgcccccgtgtcccgcatcatggtgcgccagcccaacaaccgcggcaactccggttcttccaccaacggcatgcctcccacgtcttccatggggtgcggcacctggggcggcaacatcgtgtccgagaacatctgcctgaagcactacatgaacaccacctgggtggcccgtcctctgcccgaggatatgcccagcaacgaggagctgttcggcgagttcaacaagccggacatggacgtggagtga

SEQ ID NO: 2381 - DNA, 3885 bp, Unknown
  Artificiall/Consensus sequence
atgaaacggaaaagcagtaaattcttgagtctcctgctggcggcggtcttgctcctctcccttatcgctcccgctgctctggccgctgggaccgccgataccatttatctccgcacggcagaggatctggcggggttctcccggaactgcaccctggacagctggtctcaggggaaaaccgtctatctggaggcggacattgatctgaccggcgtggactttgcccccatccctaccttcggcggcacctttgagggacagggacacaccatctccggcctgtccatcaccggcagcggcaatgtgcggggactgtttcggtacatacagcccaccggctctgtgcgggatctccacgtctcgggcagcatctctcccgctgaccgcaaaaacgttctgggcggcctggcagggaagaaccaggggaccatcacgatgtgttcgttttccgggacggtaagcggattggacagtattggcgggatcgcaggcatcaacgaagctcagggggagatcatcaactgtgctttctccggctctgttaccggggagcactatgtgggcggcattgccggacagaactacggttctatcatccagtgtgaaaacagcggcagcatcaacaccacagaggtggacacggaactggatctggacgctttgaatcgtgagcagctcaatgctgcggagaatgtacctgtgtgtactgacattggcggcatcgccgggttttcctcaggcatcctgcaaagctgcgtcaacaccggggcggtggggtatgcccatgaggggtataacattggcggcatcgtagggcagcagtccggatatctgaacggctgcaccaattccgggatgattttgggccggaaggatgtgggcggcattaccggacagttggtgccggaggtgcgtctgctctacactgagagccaggttggcgacctgttggatgaactggacgtgctgcgagacctgatcggccggaccaatgatgatgcccgcagcgcctccaacgagatctctgagcggatgcaggctatttccgaccgggcgggggaggtccagggggctatcagtgacttggcagatctcaccacagactgggccaatgaaaacattgatgcggtcaacagcatgtctgcccggatctcctggctcacggataaactgtctcccattatggaggatgccacagacgcgctggatctgatggagaagttggctggtcagatgaatgatgtgatggacgaggcgcaggaggccggcgatctggcccccgatgcagcggaccggtttgaggacgttatggacgatctgagggtcgctgcccggcatggccgggactcggcagaccacctcaaagcggctatggcgcacctgcggaatgtactggggaatccggatacggacacaaccctggcggaaatacaggcggcagtttctgaactgtccaaggatctctcggatattgacagctgttttgtacaaatatgggaaattttacagggtgcagatggtgtgcttcaggggaggccggaatgggcagctcttctggaaaagctgggggcgtttcagtctgcctgtgccgctctgccaaactgcttggaccaggtcaacgatgcgcttgctcaggtgatcgggtcggagaccgctgccccggaagcattggcgcagttgaaaagtgctgcagaggatctactggccgccggacaggcgtttgggcaggcgggggcggaactggccaaggcgctaatgaatgtcgcccctggacaggggccggatttgacagccgcttaccaaaaattacaggatgcgtcccaacagcttacagacacacagggggaagtagaaaacattctgaaagatttaggcgcgtctgaagccgagcgggatctgcaggtgaaattggacgaactgaatgctgccatcgccgccgcagagctggccgccgcagaggcggaggatgccctcgcagcattggccgggatcgaatctgcccagactgtcgttgagacactccaggtcgaactggcggccatccgtaccagcctggagcgcgcaaagctatctgcacaggagatcgccgcagccgcggaaaaattggtggtgccttccatcaatatcgaggaattggaggccgccagacaggagatacgggccgccagggatagtttatcctccgcactgcgcgcattggcccgcagcgtggacagcggcgggagtgccgtccgcaaactgcgggaattgctggagaaggccggggatgccatagatgaactgagggatgccggagataccatggaggaactgtcttctctgacttcagacatcatggaagacctttcccatgtgctgcaagaactatctgagatgcccaccatcaccatccgtcccatcagcagcgagatcaaggaacagggggatgctctggacagtatttttactgacctgatcgacagcggagatgctcttcgggagtccatgtccagcaatacggacattttgctggacgatctggacgccatcaaccggcagttcggtgtcattaccgacctgatgcgggatattctggatggttctgatgagaaatttgaggatcggtttgaggatgtgtcggacgaagcgcctgaaactacagatacgggctatctctctgacgccaggaatgacggaacggtggagggcgatgttaatgtggccgggatcgtgggctctatggctattgaatacgactttgacccggaggacgatttgatccgggaaggcgaccgctccctggacttccgatatcagaccaaggcagttgtcgcatcctgtatcaatacaggagcaatcaccggaaagcaggactacgccggcggtattgtcggtctgatggacctgggacgggttagaaactgcgagaattacggcgctgtatccagcagcaacggcgactatgtgggaggtattgccggcgcctcctggggcagcgtccgggacagctggagcaagtgccacctgtctggcagggactatgtgggcggtgcggctggattaggggctaccctgataaattgtcataccctagtgaccatcgatgagggctctgcttatctgggggcggtagcgggagatgtggacagcgacggcaccgtatccggcaacacctttaccagcgagaacctgggcgctctggacggtatcagctatgccgggaaggcggagccggtggatttcgattccctgtgcagcacggagggcgtgccggagctgttttctcagctggagctgaccttcgtggccgatggcatcaccgtagccgtggtccccttccagtatggggaagggatcgaatccctgccggagattccggcgaaaaaggggtactccgccgcctggccggatctggactatacccatctgaatgccagtcaaaccttggaagcggaatatactccctatacctccgccctttcggacggtggggaactgccggagatccttgtggacggtagtttcagcagccgggcagaagtctcacacacgattgagaatgtgacctggagtgatcgccagggaaagacgcacaccggcactgcctataccgtcacagtggacgacccggatttagagcaggtgtcctatacggttcactaccgcctgccggactctggaaaacactatgcgctatgggtacaggaggaaagcggctggtcagaagcggattttgagatcgacggacagtatctgctgctcaccagtcagacggaggagatcattttctgtattacagagcggtccagcagccttcttgtctggctcgcggccggaacaggttgcctgttgcttctggctgccgtattctgtgtgctgcgtcacattcaaaaaaagaggcattga

SEQ ID NO: 2382 - DNA, 3780 bp, Unknown
  Artificiall/Consensus sequence
atgactttgctggaccagtgtaagatctggaacgaaaacgacgagtatcagaagatcattgaggccttggaggccgtccccgcccaggagcgcaccccggagatggacagcgaactggctcgggcctacaacaaccaggccgcgccgggggaccgggagctgttccgcaaggccattgccctgctgaagccccatgaggcgtatttcgcgggggaccattgctggaacttccgcatgggttattcctactactacctggaccaggagggccgggcgctgccctatttccaggcggcgctggaagcccgccccggtgacggggatacccaggagttcattgaatggtgtcaaaagggagtcgctctgccccggttctcggagtgcttccgggagcggacggaggcggcatgggagaaatttgctcagcaggaggcacagctgcgtcaaaggatggatgaggacaaggaccatcagcggggggatgaactggtggcccagatggaggatgttctgcacctggcctttgatgacatatccttcgaaatgggcttcaacggccagaagcacgagctgatcctcaccccggagggggacaaggtcaagctgtttgaactggtctacttccagaagcacgcaccgaaaaaggtgctggagcactggaatatcctggcgggccgccagcccaaccccggcatcggactgcgtaccgacgacggctgggaggtctccggggaggatgtgcaggtctggctggaggagcggggaaaaaacagcttcgccctgtccgcctattgcgaaaagctgctccccctgctccgggaggaggagggccgggcctggtggatgcttaccaccctcaccgaccaggtcttgggcgagatttcccatatgcggtacatcgacgccttcgacgtgctggaggagcccaaaggggagccgtctattctcctgtcgggcctgccggacaagctgaagggcatgggcctggatctggctgccgacccggaggactatctggagaactacatcggctatgagatggagcccaacgaggacccggaggcggactggcggctggatgtgatcgcgggctccaccaactgcgcgcccctcatcaacggctatctgagcgctgaaaacgactccatggatgacctccacgccgacggcgtagtggcgggcttcttctgctatccactggacaccctgcgggaagaggagggtagcgacaagatctttgctttccgggacgagctggaggactatctgagcagtgcctgcggcccggacgtgctcaccctcactggcggggccaccggcatcttctgcggctatgtggacttcatcgcctgggacctgcccgccgtcctgaacaaggtccaggactttttcgcggacacggatctcccctgggccgacttccacaccttccgccgggaggccgggacggtgtccctcaaaagactggaggaggacgagctggaggagacgctgaccgggatggactacattccctacaccctggagaacgccgacgccttttaccggcagctggaacagtggaacgacgaggacgagtacacccgctgcatccaggccctgaacgccatcccggaggactggcgggactaccgctttgcctacgccctgtccagggcgctggaaaactacgccatcatcggggaccgcgaagagggcacccccggccgcaagggggacaaggccctcctgcgggccatccaggtgctggaggccgtccgggaggagggccgggacaaggcggagtggaatatgcgcatggcctatgcctatcaatacctggaggggcaggaggagaaggccatcccttacgcccagcggtggatggagctggaccccgaggacaaaaacgccccggcggtgatccgggagtgtgaggaggagctggccaaacggagcggcggagagctggagaacggagcggaagagagagcaccggctggcccggtgctaacagctgaggatgtgcgggagctggagtccatgtgcgaaggggtatccggctacttctacaaaatgctgaacttcctggaggagcggcttcaggacggtgtccgccgggggcgcttcacctgggagcgggtgcgggcggatctggacacggccctgtggtactcctacatctgcaacaatgtggatgagtacgagtattattaccgggcggcccagtggatgccggattcggagcaggcggcagagcaggcccggagcggggtctggtactatcggtacgcctgcgccctgacctactgcggacggctggaggaggccctgaagtacgcggagaagggagtcggactggacccggagtatgtgtggggctggctcatgtacggcaggctgctcagccactttggggaccgggagggggccctggcggcggcggaccgggggcttgccctggagccgggagactatgaattcaccaccctgcgccgggagattcagaaggggcgcacgctggaggagatggagttccactggatcgacccggaatctgacagaaaactccaggcggggatggacgagagcgccggagacaagaagcgggcgatctcctgcatcctctgccgccgggaggcgctggaggagatcaaggcggcccttgcgcctgtagagtgggaggcggacgccccttactgcacgttcaccatgccctatcaggggagcacggtggaggggcggttcttcgggaacgaggctgccctgtccaaggtgccggccgagtgggcgcgggagctggtccggcgcctgccggagctggaccgccggggtctgaccttcctctcagcccgggcagggctggggactgggggactggccctggagcggttcaccatccagatggaccggcggctctgcctgttctaccagcggggggaggagcagcagatggtccggttcgcccccgactttgccctgtgcgaggaggaccagcccgctctggcgcagcctgagggggggaccttcctggccttcgtgctgctggagcagccggagtgggacgcggaggaatttaagcggaccctgcgggacgactggggcatcccctgcatgacggaggagaaggacagcggggaggggggaagcaccctggtctttgaggcggagggctttctgacggcggtgagcctctaccccttccccgtgcccaaaggggaggcggagcagaatgcgggccgcaactacctgtggagcgaggcggaggagaccacacgccggcaccgggggcagatcctggtgtccaccatggcacgggacggagatgtggggcaggccgcccgcctccaggtgaagctggtgtgcgctgcctgtggacaggacggcgtgctgggcatctacgccaacgggaccgtgtaccagccggagttctatctggaggcggcccagatgatggaggacgggagccttcccctgctgaatttggtgtggccggggctgtaccgccgggagggaggcctgtgcgcctacaccgaggggctgcgcgccttcggcaaggacgagctggaggtgctggacacccgggcggagcccggggacctgcggggttttgtgctggacatcgcctcctatgtgctggagcaggatgtcaccctccgggacggggagaccatcggcttcagcgaggggcagaagctgcccatcacccgcagcgcggggatctggcacgacggcatgacgctgaagatcggatatccgtcaaaggaggagggggaggacgagaacagcggagagacctga

SEQ ID NO: 2383 - DNA, 3840 bp, Unknown
  Artificiall/Consensus sequence
atgacggtcaaggacgtatattacggaaagaccctgcgaaagagctttgcccgctatcaggagatcctggagatgcccaatctgctggagatccagaagaagtcctaccagtggttcctggacgtgggactgcgggaggtctttcgggacgtagccgccatcactgactacgccggcaatctggagctgtccttcatcgactactccatggacgagaagcccaagtatgacgtggaggagtgcaaggcccgggactgcacctacgccgcgcccatcaaggtccgggtgcgcctgcgcaacaaggagaccgaggagatcaaggagcaggagatcttcatgggagatttccccatcatgaccaattccggcaccttcgtcatcaacggcgctgagcgggtcatcgtctcccagatcgtccgttcccccggcatgtactatacccgcactgcggacaaggcggacaacctgactttcgccaccaccgtcattccctaccggggagcctggctggagtatgagaccgacctgtccgacgtgttctatgtgcgcatcgacaagaaccgcaaactgcctatcacctgcctgatccgggccatcggccccaagaccgacgccgagatcatcgagatgttcggtgaggacgagcgcatccagtccaccctggagaaggatacctgcaagaactatgaggaggccctgctggagatctaccgtaagctgcgtcccggcgagcctcccacggtggactccgctgagagcctgctcaacggcctgttctttgatccccgccgctacgacctgtccgcggtgggccgctataagttcaacaagaagatggctatgggcagccgcctgtccggccacaccctggccatgcccgtggccgacccccgtaccggtgagatcatcgccgaggccggggagaacctgaccagggagcgggcccgggagctggaggaccgaggggtcaatgaggctgtcctggatgtggacggcaagctggtgaaagtgttcgccaacaacatggtggatatgaagaacttcgtggactttgacccggaggagtgcggcatcaccgagaaggtgtccttccccgtgctgtgccagctcctggagcagtactccggcgaggagctgaaggaggcggtggccgaccacgtggacgacctggtgcccaagcacatcaccgtggcggacatcatggcctccatcaactatctcaacggcctggcccacaacgtgggcacccccgatgacattgaccacctgggcaaccgccgcctgcgctgcgtgggcgagctgatccagaaccagttccgcatcggcttcagccgtatggagcgggtcatccgggaacgcatgaccattcaggacttggacgtggttaccccccagagcctgatcaatatccgccctgtcaccgctgccatcaaggagttcttcgggtccagccctctgtcccagttcatggaccagaccaaccccctggccgagctgacccacaagcgccgtctgtctgccctgggccccggcggcttgtcccgtgaccgggcctccttcgatgtgcgcgacgtccattacagtcactacggccgcctgtgtcccatcgagacccccgaaggtcccaacatcggcctgatctcctatctggcctcctacgcccgggtgaaccggttcggcttcatcgagaccccctaccgcaaggtggataaggccaccggcagggtcaccgacgagatcgagtacatgaccgccgacgtggaggatgagtacaccgtcggccaggccaacgagccggtggatgagaacggctgcttcgtcaacgagcgcatcacctgccgccaccgcaacgagatcatttccgtggaccgcaacagcgtggactacgtggacgtatcccccaagatgatggtctccgtggctaccgccatgatccccttcctccagaatgacgacgccaaccgcgccctgatgggcgccaacatgcagcgccaggctgtgcccctgctccggcccgaggcacccatcgtggctaccggccaggagcataagaactgcatcgactccgaggtggccatcctggcggaggggcccggcgtggtcaccaaggtgtccgcccggtatatcactgtaagatatgacagcggcgagaccaaggagtaccgcctgaccaaatatctgcgctccaaccacaccacctgcatcaaccagcggcccattgtcaatgcaggccagcgggtagactatcaggacgtactggccgacggcccctccaccgaccggggcgagatcgccctgggccggaacatcctcatgggcttcatgacctgggagggctacaactacgaggacgccgtgctgctcaacgagcgcatggtgaaggaggatgtgttcacctccatccatatcgaggagtatgagaccgagtcccgggataccaagctgggccccgaggagatcaccagggacatccccaatgtgggcgaggacgccctgaaggacctggacgagcggggcatcatccgggtgggcgccgaggtgcgttccggcgatatcctggtgggcaaggtcacccccaagggcgagaccgacctgaccgccgaggagcgcctgctccgggccatcttcggcgagaaggcccgggaggtccgggatacctccctgaaggtgccccacggagagagcggcatcatcgtggatgtcaaggtcttcacccgggaggcaggtgacgagctctctcccggcgtcaacgaggtggtccgggtctacatcgctcagaagcgcaagatctctgtgggtgataagatggccggccgccacggcaacaagggcgtggtctcccgcatcctgccccaggaagatatgcccttcctgcccgacggcacccccctggatatcgtgctcaaccctctgggcgtgccctcccgtatgaacatcggtcaggtgctggaggtccatctgggctacgccgccaaggccctgggctggaaggtggccacccccatcttcaacggcgccaacgagcaggacatccaggagtgcctgaagatggccggcctggcccgggaggtgggctatgacgagcccctgatcggcaagcagctctatctggcaccccaggaggagggcggcgagctgcgggccctcactccggaggagatggcggacaacgtccaggtccgggagtggcagaaggccggccagctgcgtctggtggacggcaagaactggctgtacgacggccgcaccggcgagcggttcgacaacccggtcactgtgggctacgtctacttcctgaagctgcaccacctggtggacgacaagatccacgcccgctccaccggcccctattctctggtcactcagcagcctctgggcggcaaggcccagttcggcggccagcgcttcggcgagatggaggtgtgggccctggaggcctacggcgccgcctataccctccaggagatcctgacggtgaagtccgacgacgtcaccggccgtgtcaagacctatgaggccatcgtcaagggccacaacgtgccccggcccggcgtgcccgagtccttcaaggtgctcatcaaggagctccagtccctgtgcctggacatgaaagtgctggatgcgcagggcaacgagatcgagctgaaggacgacgacgaggacgcctaccagcccggccgccgcgatgacgacgacgatttctatttctccgcggaggactccgacttctccgccgccggctacaccctgaagggggagagcgacgacgatgacctggaagtgggagagagcacgaacgattccatggacggagaggacttctccgacgaggatttttga

SEQ ID NO: 2384 - DNA, 2517 bp, Unknown
  Artificiall/Consensus sequence
atggagcctgtatggaaaaatttttcgccatacaggctccgtgatttttattttcattttaaattaacagggaggcaaattatggctgaatacaacaaagcccagctcactgagatgatcgtgggcaagctcctgcggaattttggccgcacagtggatgaggccacccctaatcatatgttcaaggcctgcgccatggtcctgcgggatatcatgtccggtcatcagattgagaccagcaaccacgtctgggaagcccagggccggcaggtccactacctctctctggaattcctgatgggccgctctttggagaagaacgcctataatctggggctgctggacaccttgacccaggtgctggaggatctgggcttttccgccgccgacctgttcgagaccgagccagacgccggcctgggcaatggcggtctgggtcgtctggccgcctgctacctggactccatgaccactctggagatcccggccaccggctattccatctgctatgagctgggcatctttaagcagaagatcattgacggcaagcaggtggagctggccgacaactggcttggcctgggcgacgcctggcttatcgccaagatggacgaggcggaggaggtccgctttggcggcaggatcgtggaccattgggtggacggccacaataaaccggagcacgtgggctacacgaccgtgctggccattccacgtgacatggagatcgccggctacaagaccaaccacaccaacaccctgcgcctgtgggacgccaagagcccggtccccgtagatatgtccctctactcccggggtgagtacctgaaggcggtggagcagcaggccatggccgaggtcatcgcaaaagtgctctatcccgatgacaaccactacgagggcaagtccctgcggctgaagcagcagtatttcttcgtctccgccaccgcccagtctatcgtccgccagcaccgtgcccagtatgggacgctgcgcaacttccaccagaagcatgtcatccagatcaacgacacccatcccaccctggtcatccccgagctgatgcgcatcctgctggacgtggaggggtacagctgggacgaggcgtggcacatcgtcaccaacaccgtctgctacactaaccacactgtcctggccgaggccctggagcgctggccccagaacctgatcgagtccctgctgccccgcatctgggagatcctgaaggagatcgccgcccgctaccagcgccagctggagggatacttcggcggggacatgaaccgggtctcccggatggccatcatctggggtggggaggtccgcatggccaacctgtgcgtgtgcgcctgctccgcagtcaacggcgtgtccgccctccactccgatatcctcaagcgggacgtgttccatgacgcctacctccgccagcctgaccagtttaaaaacgtgaccaacggcatcgaccaccgccgctggctctctcagatcaaccccaagctggacgccctgatccgggagtgcaccggcagcgacgcctacctgctccacccggaatccatctccggcctggagaagtacaaggacgactccgccgtcctggaccgcctggagtccatcaaacaggagaacaagcgccgttttgccggctatgtggcccgggagtccgggatcatcctcaacaccgacgccatcttcgacgtacaggtgaagcgcctccatgagtataagcgccagctgctcaacgtgctgcatatcgtgtgcctgtaccagcagctgcgggacgatcccaatatggacttcacgccccagaccttcctcttcggcgccaaggcggccccgggctaccacgtggccaaacagatcatccagctcatcaactccctggccgcccagatcaacgccgaccccgtctgcaaggataagctccaggtggttttcctggagaactaccgggtctccctggcagagaagctgatgcctgcctccgagctctccgagcagatctccaccgccggcaaggaggccagcggcaccggcaacatgaagttcatgatgaatggcgccctcaccatcggcaccctggacggagccaatgtggagatgcaccagcagctgggggatgagaacatcttccttttcggcctcaccgccgaccaggtggaggagcgccgccgccagggctatcgctctctggattactaccagcaggacccggtgctcaagcgggtgctggaccagatctccgccggcttctccgacggcagggcctacaccgacctgaccaaccgcctgctcttcggcggagggggcgggatcgccgatgaatatatgctactggccgactttgacagctactgtcaggcccaccgccgctctctggaggtctacaaggaccggagagcctgggatcagaaatctctcatcaacatcgcccggtccggcatcttcgccgccgaccgctccatccgggactacgcccgggacatctggcatgtccccacccggttcgactga

SEQ ID NO: 2385 - DNA, 2631 bp, Unknown
  Artificiall/Consensus sequence
atgaatatgaatcaatttacccagaaatcgttggccgccattcagggcgcccaagacatcgccctggagtacgggcaccagcagatcgagcaggcccatctgctcatggcgctggtccaggacggcgaggggctgatcccccagctgctcaccaatatgggcctgaccctccccagcttccaggccgccgtccagcacgaggtggagaagctgccccgggtctccggtggaggccgggaggcggacaaggtctatgtggctcaggacgtggaccgtgccctgaaatccgccgagtccgccgcggcgtccatgaaggatgagtatatctctgtggagcacatcctgctgggcctgctggacagtgccaacagcgccctgaaggagctgttccgcacctacaacgtcacccgggaaaaagtgatgcaggccctgacctctgtccggggcaaccagcgggtcaccagtgacaaccctgaggagacctatgacgccctgaagaagtacggcaccgacttggtggagcgggcgcgccagaacaagctggacccggtcatcggccgggacgacgagatccgcaatgtcatccgcatcctctcccgcaagagcaaaaacaatcccgtcctcatcggggagcccggcgtgggtaagaccgccattgccgaggggctggcccagcggattgtgaagggagacgtgcccaacagtttgaaggacaagaccatcttctccctggatatgggcagcctcatcgccggggccaagtaccggggcgagtttgaggagcggctgaaggccgtcctcaacgaggtgaagaagtccgaggggcgtatcatcctctttatcgacgagctgcacaccatcgtaggggcgggcaagacggagggctccatggatgcgggcaatctcctcaagcccatgctggctcggggagagctgcactgtatcggcgccacgaccctcaacgagtaccggcagtatattgaaaaggacgccgctctggagcgccgcttccagcctgtcatggtgaatgagcccacggtggaggatgccatcgccatcctccgcggcctgaaggagcggtacgaggtctatcacggcgtcaagatcaccgacggggccatcatcgccgccgccactctctccaaccgctatatcactgaccgcttcctccccgacaaggctatcgatctggtggatgaggcctgcgccatgatccgcaccgagatcgactccatgcccaccgagctggacgtcatccagcggaagatcatccagcacgagatcgaggaggccgctctgaaaaaagagacagataagctgtcccaggagcatctgtcggagatccagaaggagctctccgacatgcgggatgagttcaacgccaagaaagcccagtgggagaacgagaagaatgccattggcaaggtccagaagctcagggaggagctggaggaggccaacgcccagctggagaaggcccagcgggagtacgacctggagcgggccgcccagctccagtacggccgcatccccgagctgaaaaaggccctggaggcggaggagcagatcgccaatgaggggcggcagcgttccctgctgcgggacaaggtcaccgaggaggagatcgcccgcatcatcgagcggtggaccggaatccccgtctcccggctcatggagggggagcgtgagaagctgcttcacctggaggacatcctccaccagcgggtggtgggccaggacgaggcggtacgcctggtgtccgaggccatcctccgcagccgggccggcatcgctgaccccaacaagcccattggctccttcctgttcctgggccccaccggcgttggtaagaccgaactggccaagaccttggctgaggccctgttcgacagcgagaagaacctggttcgcatcgacatgagcgagtatatggagaaattctccgtgtcccggctcatcggggctcctcccggatatgtgggctatgaggaaggcggccagctcactgaagcggtgcggcggaaaccctactccgttatcctctttgatgaggtggaaaaggcccacccggacgtgttcaacatattactccaagtattggacgacggtcgtattacagatagtcaaggccgcaccgtggatttcaagaacaccatcatcattcttacctccaacctgggcagccagttcctgctggacggcatcgacagccggggggagatcagccaggaggcccgggagcaggtcagcgatctgctcaagcggtccttccgcccggagtttctcaaccggctggatgagatcgtgttttacaagcccctgacaaaggacaacgtgacccatatcatcgatctgatggccgccgacctgaaccgccggctggaggacaaacagctcaccgtggtcctcacccccgcggccaaggaggagatcattgccagcgcctacgaccccatctacggcgcccggcccctgcgccgctatctccagcatacggtggagacccttatcagcaagaagatcattgccgaccaggtggagcccggctcccgcatcaccgtggactgccgggatggacagctcaccgtggacagccgggaggtgctcaccggcgaggtcatcgacgcctga

SEQ ID NO: 2386 - DNA, 2055 bp, Unknown
  Artificiall/Consensus sequence
ccggtcctccgggcggaacaagtggatatcggaacggcagggaccagcggagagagcctcatctctcccgcttctgtattctgccttctgcatttcgatatggaggttattatggcagaagaattggaactgaactccccccaggtggagcacgagtacggcgcctcggagatccaggtgctggagggactggaagcggtgcgcaagcggccgggcatgtatatcggctccacctcggagtcaggtctgcaccacctggtctatgaaatcgtggacaactccattgacgaggccctggcgggctactgcaccgacatcacggtgaccatcaatcccgggaacaccatcactgtcactgacaacggccgcggcatccctgtggatatccagccccaaaccgggcgtcccgcgctggaggtggtgttctctgtcctccatgccggcggcaagttcggcggtgggggctacaaggtgtccggcggcctccatggcgtgggcgccagcgtggtcaacgccctgtctgagtggctggaggtccaggtacacaagaacggccagatctatgagatgaagttttcccggggaaagatcacccaggagatgaaggtggtgggaaagaccgaccatacgggcacgaccgtcaccttcaagccagacccggagatgttcgagactctggagtacaactatgacactctccacacccggatgagggaggaggccttcctcaatgctggcctgcgcatccagaccgtggacctgcgccccggccgggagcaggaggacgatatgtgctacgaggggggcatccgggaattcgtcaccttcatcaaccgaagcaaggacccgctgcaccctgacgtgatctatatgtccggcaaccgggaggactccatggctgaggtggccctccagtacaatgacagctataacgaggtcatcgtctccttcgccaacaacgtccatactccggagggcggcatgcatgaggagggcttcaaacgtgccctcaccaacgtgctcaacgcctacggcaagaagatcggcgtgctgaaaaacgatgacaaagtctccggcgacgactgccgggagggtctcacctgcgtcatttctgtcaagctcaccgacgcccagttcgagggacagaccaaggccaaactgggcaacagcgagatccgcaccctggtgaacgccattgtcagtgagaagctggagatctatctggaggagaacccggcggtgggccgggccatcttggacaaggccctcaccgccaaccgggcccgggaggccgcccggaaggcccgggagtccatccgccgcaagaccgctctgggcggggccgctatgccggacaagctgcgggactgcaacgaggccaaccccgagctcaccgagctctacatcgtagagggcgactccgcaggaggctccgccacccagggccgggactcccggttccaggccatcctccccctgtggggcaagatgctcaacgtggagaaggcccgggcggacaaggtgtacggcaacgacaagctcacccccgtcatcaccgccctgggggcgggcatcggagacgagttcgacctgaataagctgcgctatcacaaggtcatcatcatggccgatgcggatgtggacggtgctcatatccgcaccctgctgctcactttcttcttccggttcatgcgccccctcatcgagaatggatatgtctactccgcagtgccccctctgttcaagctgacccggggcaagcagatccgcctggccttcagtgaagaagagcgggataagatctccgccgagctgagaggggacaatcccaacgccaaggtggatatcagccgcttcaagggtctgggtgagatgaacccccatgagctgtgggagaccactatggacccggagaagcgcaccctgcgccgcatcgagctggacgacgccgtccgggcagatgaggtgttcaccgtcctgatgggcgaaaaggtggagccccggaaggagttcatcgagcgcaacgccaagtacgcagtaaacctggattactga

SEQ ID NO: 2387 - DNA, 2667 bp, Unknown
  Artificiall/Consensus sequence
atgaacgtctccaacggcaagtgtatccgagatctctcccgtaagagcctgcgagccaaccgcacccggaacctgatcgcggtgctggccatcgccctgaccacggtgctcttcacctccctgttcaccatcgccatgtccatcaacgacggcatccagcagaacaacttccgccaggtgggcggcttctcccacggcgggttcaagtacctgacagaggagcagtttcacgaattgaaggacgaccccctcatcgaccagtggggtctgcggcgctttgtgggcatgcccagtgaggtgcccttcaacaaaagccatgtggaggtgggctactccgatgccaacgaggcccactggatgtactgcgacccggttgaggggcgcctgccccaggagggcaccgatgaggccgccacggacacccatgtgctggagctgatgggggtcacgccggagatcggcgccaagttcacgctcacctttgacgtggacggccatgagaccacccagactttcaccctgtgcggctggtgggagtacgacgaggccattgtggccaaccacattctgatcccggagagccgggcggacgccatcctgacggagaccggcgtggtgcccgggcagaccacggacggcatgaccgggacctataacatggatgtgatgctgaaaaatggggcccgaaatattgcaggcgacctggaccagatcctggaaaaccatggctatcaggccgagagctccgctcagccgggctatatccataccggcgtcaactggggctacaccggcgcccagctgtccggcagcatggaccccgccaccttcatcgccatctgcgcggtgctgctgctcatcatcttcaccggctacctcatcatttacaatgtgttccagatctccgtcaccaacgacatccgcttctatggcctgctgaagaccatcggcaccaccccccggcagctgcggcgcatcatccggcatcaggccctggccctgtccctggcgggcatccccctggggctggtgctgggctggctcatcggcggacagctgacgccggtgatcgtccggcaggtgaacggggtgtccaatgtggtgtcaatggacccgatcatttttgcggcctccaccctgttttccctggtgaccgttcttctctcctgccgcaagccgggaaaaatggccgcccgggtctcccccatcgaggcggtgcgctacaccgagggcggaaacctgaaacgcaaagccaagcgcagagccaagggcgtctccctcttctccatggcctgggccaacctgggccgcagccggggcaagacggcggtcaccgtcctctctctgtccctggcggtggtgctgctcaccgtgacggtcaccttcactcagggctttgacatggacaagtatgtctccaacttcactgccagcgacttcatcgtggccgacgcgggccagtttcagaccggcggcgacgcctataacgacgagatggacgtgacggaggacgtgatcgccgccatcgacgcccagggcggcatcaccggtggcggcttggtctacggcgatacctccgctgcgctggagttcgtcaccgaggagtactaccgctccgtctggagccgctggaacacccccgagcagctggacagcatggtccacttcaaggaccgcaatgaggagggcctgctggccgaccgggtgcagctctacggcatggagcagttccccctggaccacctgacggtgctggagggagacctgtccaagctcagtgaacccggcgggcggtatgtagccgctgtgtacagcgatgacgactacggccggcccgagttgggctcccactgggcccggctgggggacaccgtcaccatccggtatgtggaggaatatgagtactataatcccgacaccggagaggtgtacggcccatgggagaacgtgcccgagggtgccaactgggtggaccgggcggtgaagtaccgggacgtggagtacgaggtggccgccctggtgaccgtgcccatggccctgagctaccgctattacggcgcggatgagttcatcatgaacgaccagaccttcatccaggacacgggcacggacagcgtcatgtactatgccttcgacaccacggatgaggccaacgccgccatggagtccttcctggcggactacacggaaaatgtgaatccccagttcgactatgagagcaagtccacctacgccgcggagtttgaggggatgcgatccatgtttctgctgctgggcggggccctcagcggcatcgtgggcctggtaggggtgctgaacttcttcaacgccatcctcaccggcatcatcaccaggaaacgcgagatggccgtcctccagtccatcggcatgaccggaaagcagctgaagaccatgctggtctgtgagggcctgctgtacgccctgagctctgtgctcctgtccctggtcctggcggtggtcctgggccccctggccttctccgcccttcagagcatgttctggttcttcacctaccgcttcaccctggcccccatcctggcggtggctccggtgtttgccctgctgggcgccctggtccccctggcggtgtaccgctccatctccaaacacaccgtggtggagcgcctgcgggagtcagacaactga

SEQ ID NO: 2388 - DNA, 2613 bp, Unknown
  Artificiall/Consensus sequence
ttggaacaggagtcctccggtcgactgaagatcttttttggctacgccgccggagtggggaagacctacgctatgctggacgccgccctccgcgcaaaagaggcgggcacggacgttgtgctgggctttctggcacccgccgcctatcctgataccctggcactggccggaggactggaacggctcccgcccctcatccctcccggtggagggcagggcgaatttgacctggacggcgccctccgccgccgtccccagctgatcctagtggatgagctggcccactccaacaataagggagcccgccacgccaagcgctaccaggatattgccgagctgcttcgcgcgggcattgacgtctattccaccatggatgtgcagcagctggaaagcctgagcgatgtggtctcctccatcaccggcttctccgccccggaacgcgtcccggaccaggtctttgactctgctgaccaggtggagatcgtcgatctggagccctccgaccttctggcgcgcctgcgggccgggaccatcggcggaggggaagggcaccttttgaccgagcagaccttggccgccctgcgggagctctccctgcgcaggaccgctgaccgcctggagcggaagccctccggtggggacagatatccccccagggcccgggaacacattctcatctgcctgtccggctctccctccaacgagaaggtcatccgcactgctgccaggatggcagaggcatttcacggcgcctttaccgcgcttttcgtggagactccttcctttcagggccagagcgacaaggaacgccggcagctgcggaacaatctgcatcttgcagaggagctgggcgcccggatcagcacggtctacggggatgaccccgccattcagatcgcggaatacgctaaagtcagcgggatctccaagatcgtgctgggccgcagtccccagaaacgcggccccctcctgggcgccaagagtctgatggaccgtctgggagagctggctcctgacctggatatctacatcatcccggaccaggtccagcggcccgcccgccactcctggcagccctatcttctccaggagcgcttctccgtccgagatcttttcaaggccctcctgatcctggctacctgcaccgccgtgggctttctcttccagcgagcgggcttttccactgaaaatgtgatcatggtctatatcttgggcgtcctcaccatctccatggccaccacggggcacagctacagcctgctggcatccctctgctccgtcttcatcttcaattacttttttacctacccctattttactttgatgagcgaccccagctatatcgccacctttgccgtcatgctgaccgtagcgctgctgggcagctctcttaccacccgtgtcaaacggcaggccatccagagcgcccaaaaggcataccgcactgagatcctgctggagaccagccagaagctccagaaggcggaggggagccgggaaatcctggcggtcacggccacccagttgaaaaagctgctggagcgggacgtcctgatctattccgccgacgaggacggattggagcaggaggccatgctgttccccgtttccaaaggcggggatatgtctgcatatctcacttcctcagagcgggcggtggcggagtgggtctggaacaacaacaagcacgccggcgctaccacccacacccttcccagctctaaatgcctctacattgcggtccgcggctctgacaaggtgctggcggtggttggcattgccatccccaatgctcagaaggtggactcctttgaaaaaaatctgacagtagccatcctggacgagtgcggactggcgctggaaaaggagctgacggcgcgcgccaagcagcagatcgaggagctggcccatcaggagaccctgcgcgccaatctgctgcgggccatctcccacgacctgcgcaccccactgaccagtatatccgggaacgccggcatcctgatggagaacggggccgtgctggatgaggagaagcggcgctacctgtaccgctccatctacgatgactccatgtggctcatcaacctggtggaaaatctgctctccctcacccggatgggcaacggctctgtttctctgaacatccgcccggagcttctggatgaggtctttcatgaagccctgtcccatctggaccgcaatgcggagcagcaccatatctctgtagaactggaggacgatctgttgatggcggatatggacgcccggctcatcgtccaggtggtcatcaatctggtcaacaacgccatcaagtacacccctgccggttcccacatctccttgtccgctgtccgggccggtccttttgtgcaggtcgaggtctccgatgacggtccaggtattgcggacagcgccaagcagaaaatatttgatatgttttataccgcggacaactcccgcggagatggccggcgggggctgggcctggggctgtccctgtgcaggtccatcatcaccgctcacggcggtgagatatcagttcaggatcatcagccccacgggtcagtatttcgtttcaccctgagggcctcggaggtaaaaatgtatgaataa

SEQ ID NO: 2389 - DNA, 2697 bp, Unknown
  Artificiall/Consensus sequence
gtgtcagaagaacagaacagtcgtttatataacgagaacaacgattacggggagcgggattacgccccccgcaagtccggaaaaaagaagaagcggaaggagagcggcggccatgtgggcaggcgcatccttcaggtgctgggcaccctgctgcttgtggggctgtgtacgggggcaatcctgtgctgcttcgccgccgtctatatcaagacggtcatcatcccggaggccggagccgtggacctgagccagttcgcggtgggagaaaacagcgtgatgtactacatggaccaggacaccgggaactaccgggagctggtcactctggcggcagaggagaacgccgagtgggtgaactatgaggacatccccgaagacctgatcaacgccaccgtggccattgaggaccggcggttctgggagcacaacggtgtggactggaaacgcaccgctgcggccatcctctacatgttcactggtcaggatatccagggcggctccaccatcacccagcagctcatcaaaaacctgacccagtacgacgatgtcaccgtcaagcggaaggtcatcgagatcttccgagccctccagttcgacaaggactacaccaaagagaccactctggagtggtacctcaacttcatctggctgggggaccgctgtcggggtgtaggggcggcggccatgaactactttggcaagcccgtgcaggagctcaccctggcggagtgcgccagcctgatctccatcaccaataaccccaccatctatggcccttactccgatgctgtcttcaccaactcggagaccggggagcagaagactgcccgggacaagaacaaggagcgccaggaactggtgctgtggagcatgctggaccagggctatatcactcaggaggagtatgatgaggccgtggcccaggagctggtcttcgaccgggcggcgggggagtccactccctctaccatctactcctggtatgaggagcaggtcatctccgatgtgaaggacgacctgaaggcccagtacggatacagcgatgaggcggtctccctgctgctgaccagaggcggcctgtctatctatacctgtgtggacccggatgtccaggcccaggtggagcagatatacagcgaccgcaccaacctggactacacttccagcagcggtcagcagctccagtccgccatcaccgtcatcgacaacgagacgggcaacctagtgggcatcgccggccgggtgggggagaagacgggcaacctgtggatgaacttcgccaccgacagcaagcgtcagcccggctcctccatcaagcctctgtcggtgtacgcccccgcctttgagatgggcctcatcagccccatctccgtgctggatgactatccccacgaggtgatgggcggccggccctggccggtgaacgtggacggccgctaccggggactggtcaccgtgcgtcaggccctgtccaactcctataacaccgtgtccgtgcgggtgctggccgacttggtcaccccggagaacagcttcaactttgtggaggagcacttccacctcgatttggaggatggtgtggagataggcggccagatgaagagcgacatcggggtggcccccctttccatgggcggcctgacctacggcgtcaacacccgggacatggcggaggctttcgcggtgttccccaacggcggcctctatcagaagtcccgcacctacaccaaggtgacccgggaggtggatggcgtggagaccgtactgctggaaaaccagcctgagtccgaggccgtactcaagtcggagaccgcctactatgtcaactccatcctgcgggaagtggtcacccgggtcaatacgtcgggcaactttgacagcggcatggccatcgccggcaagaccggtactaccgatgacaagtacgaccgctggttcgtgggctacaccccctactacaccgcggcggtctgggtgggctttgagcaaaacgagcgggtgcctgcctccgggaacccggccctgaagatgtggactctggtcatgtccggtgtccacgaggggctggaagaccggaagttctctgagcccgccgggctgaccaccgtcacctactgcctggacagcggcctgctggccaccgactactgccggatggacccgcggggggaccgtacagccagaggaaccgtcttccagggcgatgcgccgaccgaattctgcaccagccacacggcggagaccactgttacggtatgcctggactgccccatcctggatggaaacggcgaggagaccggcctgtaccacctggccggggaattctgcccggaggagagccggcaggaagtgagcctgctgggctaccagcgggaggacgtgggaggcgccggcgcagaggacgccaagtattttctgggtgtgacccaggaggccgggccctgtacggtccacactgcggcccagcccgacccggatctgccctttgatcccaaccagccatggaccccagcgatccgtggaatcccaacaccaacccactggatcccacagggcagggcggcgggggtgccgccgaccctggacaggaggacccggacgcgcctcagggcggagagacggaggaccccagcgggacggaccccatcatcaacccggagacagggaggccctacggatattgaacaaaaaacgggc

SEQ ID NO: 2390 - DNA, 3558 bp, Unknown
  Artificiall/Consensus sequence
ttggagatccagggcttcaagtcctttccggacaagacggtgctcacctttggggaggacatcaccgccatcgtagggccaaacggcagcggaaaatccaatatctccgacgccatccgctgggttatgggggagcagtccacccgggccctgcggggagggaagatggaggatgtgatcttcggcggcactgctcagcgccgccagacggggtatgccgaggtgtccctcatcctggacaacaccagccacatctttcccatggatgagagcgaggtcatggtgacccggcggtattaccgctccggggagagtgagtactatatcaaccgccgctccgtccgcctcaaggacgtcaacgagctgttcatggacaccggcttgggccgggagggctactccatcatcggccagggcaagatcgacgagatcctctccgtcaagagcgccgaccgccgggaggtctttgaggaggccgccggcatctcccgctaccgccaccggaaggaggaggcagagcggaagctggtccatacggacgagaacttggtccgggtcaacgacaagatcgccgagctggagctccaggtggagcccctgcgggagcagagtgagcgggccagaaagttcctggtgctgcgggacgagctgaaggggctggaggtctccgtgtggctggacaccctggagcggctgcgggccagccacatcaagctggacgccgattatcaggaggctgcccggcagaaggaggaggcccgggtggccctggagcggctgtatgccgccgccgaggccctctccgcccagatgcgggagaaggacgtggaggcggaccggctgcgctttgagagccagagccgggaggccgctgcggcggagctggagagcgctatcgcggtgctgaagaacaatgtgcagaacaacctggacaacgctcagcgcatccgggcggacctggaccagcaggaaggccgggcggacagcctggcgggccagatcggccagcggcaggagcggctggccgaaatcgaggacaagctgactcggatgcgggaggagctgcggggcaagagcgagcaggcccaggaggcggcccagtctgccgggacactggcacgggagctggaggaactgcggcagaaggaggccacggagacggccaccgccgccgaggccaaggccctgctctccgccctggcggctgccgctcaggaggtgctggaccgggacgagacggtgcgccaggagctgcgggagctggacagccggctggaggaggggcgcgccgcccagcgtcaggcccggaaggccctggccaaggcggtggaggagcgggacgcggtgcagaacgtcatcagcggctacgccctgcgcctggagtcacgccggaaaaaggcggagcaggcccgggagcgccatatgaagctccagatggacgagaatgccctgtcatcccgggtgaagatgctcaccgagatggagaagctccacgagggctactccaaggcggtcaagctggtgatgggggaggcccagcggggaagcctccagcatatccacggtccggtggccgacctgctgaaggtgccggaggagtacaccgtggccattgagaccgcgctggggggcgccatgcagaacctggtggtggaccgggaggaggacggcaaggccgtcatccagtatctgaagcgccgagacgcaggccgggccaccattctgcccctcagctccatccggccgggggagctgagggagggacaggccctccggcgggagcccggcttcgtgggggtgggagatcagctgatctccttccagccccagtaccggaacgtgttttccaacctgctgggccgggtggcggtgatggaggacctggaccacgccatcgcagcggcccggaaatacggctataagttccgcatcgtcaccctggacgggcaggtgctgaaccccggcggctccatgaccggcggctccgccagccgcagtgccggcatcctgagccgtgccaacgagctggagcggctgaacgaacagggccggggcctgcgggagcagctggcccaggccgccaaggcgctggaggaggcggaccgggaggccgccgccgccggctatgagatggagacggcccagagccagctgcgggagtgggaggacgccatcctgaaggctgagggcgaggcggcccactgcgacagcgtggtggccgacctggagcgccagtcgtcgtcccagcgggaggagctggagcagctgaagagccgctctgcccagatcgagtcggacacccggggggccaggagccgcatccaggagctggagggggccgccgctgccctgaagagcgaggcggagggaaaggtcagaggccagacggatctccaggaccggtccgcccgcatcacccgggagctgtccgagctcaccgcctccctggccgccctggaggcggagcaggagaccacggccaagagcctgggtgagctgaagagcctgcgggacgacatggcgggggaccgggagcagaaccaggccctcatcggccagtatgaggagaagaaccgccagttcacccaggagatcggggagaagacagcacgcctccaggagttgcgggcggagaatcaggtccgcagcgaggagatccgcgccctgggcgacgaaaagctggccctggagggacagcgcaaccaggcagataaggacagcagggccaagaacgacgagctgctggccatggagcgggaggtctccatactggagcagcggaaggtggctgccgccatggaggagaagcagcttttggacaagctgtgggagacctacgagctgtcccacgaggcggccaagcagcaccgggtggagatcgagtcggtgcccaaggccagccggcgcatcggggagctgaagcgggccatctccagcctgggctccataaatttgggggccatcgaggagtatcagcgggtcaacgaacgatacacctacctcaccgaccagagagacgatgtccagcgggccaagggggagctggaggagatcatcgcggacatcaccggggagatgaagaccatcttcgcccgggagttccagaccatcgaccaggcattcgggcagaccttcacagagctcttcgggggcggcaaggccacgctggagctggaggacccggaggacatcctcaactgcggcatcgagatcaaagtgcagcccccgggcaaggcgctgaagatcatcaccctgctctccggcggggaaaaggcattcgtggccatcgccctgtatttcgccattttgaaggtccggcccacccccttcgtggtgatggacgagatcgaggccgccctggatgacaacaatgtggcccggttcgcccattacatgcgttccatggcggacaagacccagtttatcgtcatcacccaccggcgcggcactatggaggaggccgacgtcctctacggcgtcaccatgcaggagcagggcgtgagccgtatgctgacgatcaatctcaacgacgtggagaaagagctgaagatccggtga

SEQ ID NO: 2391 - DNA, 3480 bp, Unknown
  Artificiall/Consensus sequence
atggcctttgtccacttacatctgcatacggaattctcccttctggatggcgcctgccgcatcaagaagctggtggagcgggtccgggagatcggacaggacgcggtggctatcacagaccacggggtcatgtacggggtggtggatttctacaaggcatgcaaggaggcgggcatcaagcccatcatcggctgtgaggtctatgtggccccaaggggccggacccggttccagaaggtccacgagttcgactcctccttccaccacctggtcctgctgtgccggaatgaggagggctaccgcaatctctcctacatggtctctcaggcgttcctggagggcttttacatcaagccccgcatcgacctggacctgctgcgggagcactgcggcggcctgatcgcctgctccgcctgcctggggggcgaggtgcccaagctgctggctgcaggggactatgacaaggccaaagaggttgccctggagatgcgggaactgttcggcgcggatggctactatctggagctccaggaccacggcatcccggtccagcgccaggtgaacggggggctgatccggctgcacgaggagacgggcatccctctggtggccaccaacgacgcccactatctgcggaaagaggacgcggagatgcaggacatcctcatgtgcatccagatgggcaagacggtggatgacccaaaccggatgaagttcgagaccgaggagttctacgtgaagaccgaggcggagatggccgccctctttcccaattacccggaggccctggagaacaccgtgaagattgcccagctgtgcaacgtggagttcgagttcggcaagtaccacctgccccacttccagctgcccgaggggtggaccgatggggacgcctacttcgagaagctgtgcatggacggcttccgctggcgctacccctcccagccccaggagtatctggacaagctgcgctatgagatggacatgatccgcaagatgggctttgtggactacttcctcatcgtctccgacttcatcgcctacgccaagggccacggcatccccgtggggccggggcggggctcggcggcggggtccatggtgtcctactgcctgaacatcaccgacctggaccccgtgaagtacagcctgtacttcgagcgcttcctgaacccggagcgggtcaccatgcccgatatcgacatcgacttctgcatccgccgccggcaggaggtcatcgactacgtggcccaaaagtacggggcggaccacgtggcccagatcgtcactttcggcaccatggccgcccgggcggcggtgcgggacgtgggccgggtgctgaacatgccctacgccgacgtggatgtgatcgccaagcagatccccagcgggccgggggccctgcatatcaccctggaggacgccctgaagctgtccaagcagctcaaggagtcctacgacggcagccctcaggtgaaaaagctcatcgacaccgccagggccatcgagggcatgccccggaacacctccacacacgccgccggggtggtcatcaccagccggccggtgagcgattatgtccccctggccaaaaacgacgacctggtagtcacgcagtacatcatgaccaccctggaggagctgggcctgctgaagatggacttcctgggcctgcggaacctgacggtgctggacgacgcggcccggctggtccggcgcagccacccggacttccacaccagccagatcccggaggatgacccggccaccttccagatgctctctgaggggcgtacttccggcgtgttccagatggagtccgccggcatgaccggggtgtgcatcggcctgaagccccagagcatcgaggatatcaccgccatcatcgcgctctaccgtccgggccccatggagtccatcccccggttcatcgcctgcaagcacaacccggagaaggtcacctacaagcaccccgctctggtgcccatcctgtccaacacctacggctgcatcgtgtatcaggagcaggtgatccagatcttccagcagctgggcggctactccctgggccaggcggacatggtgcgccgggccatgtccaagaaaaaggtgaaggacattgagcgggagcgggagaccttcctccacggggacccggcgcggagcatcgccggctgcgccgccaacggcatccccgaggcggtggcccagagcatctacgacgagatctacgactttgccaactacgccttcaacaaggcccacgcggtgtgctacgccgtggtggcctatcagacggcctggttcaagtgccaccaccccaaggagtacatggccgccctgctcacctcggtgctggactccagcgacaaggtggcggagtatatcgccgagtgcaaggagtggcacatcagcctgctgcccccggacatcaacgagtcggaggcggacttcaccgtctccgaggggggcatccgcttcggcctggtggccctgaagggtgtgggccggagcgtcatcaacagcctgctggaagagcggagcaagggtggaccctttacagactttatggacttctgcgaccgcatgttcgaccatgacctgaaccggcgggtgctggagagccttatcaagtccggcgcctttgaccgcatgggctgtaagcgctcccagctgatggaggtcttcggccaggtgctggacggcatcgccgccagccgcaagcggaacgtggagggccagctggacctgttcggaatggggggcggggaggcggagcaggcggccctgccggctctccacctggccaatatccctgagtacaccccccagcagctgatgaccatggagaaggaggtcaccggtctctacctcaccggccaccccatggacgcctatcgggaggcggcccgccgcaggggggcggtgaccatcggctccattctgagcgacttcgcccgggaggacggtcccgccgtctaccgggacggccagatggtgaaggtggctggcgtgatctccacatataaaaccaggaccacccggaacaataccctgatggcctatgtcagcctggaggacgacaccggggggatggagctgctggtctttgcccgcgccctggaccagagcggcggatacatccgggagaaccaggctatcctggccagcggcaggatctccgtccgggacgagaaggagccacagctgatggcggacgagatccgccccctggacacacccgaggcggaggagcggcgggaggcgggggagcggaagctcttcatccgcctgcccggcccggacgaccccaggacccgaaaggtgaagctggccctctcctttttcccgggggagcagccggtggtgctgtattaccaggatatccggaagcggtccaagggatactgtatgatacacccctccctgctggccgacctgagagagcggctgggggaggagaatgtggtggtccagtga

SEQ ID NO: 2392 - DNA, 2934 bp, Unknown
  Artificiall/Consensus sequence
atgagtctgcgcatcggtatcgacatcggctccaccacggtgaaagtggtagtgctggatgaacagaacaagctgctgttccgctcctatgagcggcactactccaagacccgggagcgggcctgtgagaccctgaagtccatctcgggccagctcagcggccagcgggtcaagctggtcatcaccggctccgccggcctgggggtggccaaggctgccggcctggacttcgtccaggaagtgtacgccaccgccgccgcggtgaacacctacattccggacaccgatgccgtcatcgagctgggcggcgaggacgccaagatcatctttttcggcggcgcgctggaggagcggatgaacggctcctgcgccggcgggacgggcgccttcatcgaccagatggccaccctgatgaatgtgtcggtgaacgagctggactctctctccctgaagcacgagaagatctaccccattgcaagccgctgcggcgtgttcgccaagagcgatatccagcccatcctgaaccagggcggtcggaaagaggacgtagccgcctccatcttccaggcggtggtggaccagacggtagacggcctcacccagggccgggagctgaagggaaagatcgtctttctgggcgggcccctccacttcctgatgggcctgcggcagcgttttgtggagaccctgaagctggacggggagcacgccgtctttccggaagacggggactgcttcgccgccatgggcgcggccctgtgcgccaccgattacgagcccgtcccctttgaggacgccctgaagcggctggaggagagccgggagaccaacacctcggcggacaccatgccccctctctttgacacgcaggaggagtacgacgcctttctggcccggcacaatgccagccggcccccagagacggacatccacacttacgccggccccgcttggctggggatggatgcaggctccaccaccaccaaactggccctcatcaccgccgacggcggactgctctacacctactaccactccaacctgggcaacccggtctccatcgtcctggagcagctgaaaaaaatctacgagctgtgcggcgaccgcatccagatcaaaggcgcggcggtcaccggctatggcgaggacctgatcaaaaacgccttctcctgtgacctgggcctggtggagacggtggcccactacaaggccgccgcccacttcaaccccgatgtggatttcatcatcgacatcggcggccaggacatgaagtgtttcaagatccgcaacggcgcggtggactccatcatgctcaacgaggcctgttcctccgggtgcggctcctttatcgagacctttgccaaggccctgggctccaacatcgccgacttctccaagatgggcctgtttgccaaaaagcccgtcaacctgggctcccgctgcaccgtgttcatgaactccagcgtcaagcaggcccaaaaggacggcgccagcgtggaggacatctccgccggcctgtctatctccatcgtgaaaaacgccatctacaaggtcatccgggccgcctccgctgacgacttaggccagcacatcgtggtccagggcgggaccttcctcaatgacgcggtgctccgctcctttgagcgggagctggggcgggaggtgacccggcccaccattgccggcatcatgggggccttcggagccgctctggccgcccgggacctgcacctggagcggagcgccctgctctcctcccaggacctggagaagtttacccacaccgccaagcccgccacctgcggtctgtgcaccaaccactgctccctcactgtcaacaccttcgacggcgggcggcgctttatctcgggcaaccgctgctcccgccccctgggggaggagccccaccacctgcccgacctgatgcggtacaagtatcagaagctccgtgctctccacggcaagggggagggggacggttcccggggccgcatcggcatccccttcgggctgaacatgtacgaaaacctccccttctggttcactttcttcaccaagctgaactttgaggtggtcctctcccctgagtcctcccgcaagctgtatctcaaggggcagcgcaccatcccctccgacacagtgtgctaccccgccaagctgctccacggccacgtagaggccctggtggaggcgggggtggacgccgtctggtacccctgcatgtcctacaacaacgacgagggcatcggagacaaccactacaactgcccggtggtggcctactaccccgagctgatcgccgccaacgtgccctctctaaagcagacccgtttcctggacccctatgtgggcctgtggcggcacaaggacttcggcaagcgcatcgcccagctgatgcatcaggagttcggcatccccaaaaaggagtcggcagccgccgcccgggccgcctacgaggcctatgaggcctacgtccacgacgtacgcgccaccggcaaggaatacatcgactacgcccgctcccacgggctgaacatcatcgtggtgtgcggccgcccctatcacatcgacccggagatcaaccacggcatcaacgatctgatcacctccttcggcttcgtgctggtcacggaggacgccctgagctatctggagggctacgccccccggaaggtgctcaaccagtggaccttccagagccggatgtacaacgccgcccggtatgtgtgcacccagcccgacatgcaggtggtccagctggtctccttcggctgcggcaccgacgccatcaccaccgacgagatgcgctccattctggaggacggggataagctgtacactcagctgaagatcgacgacatcagcaacctgggcgccgtcaagatccgcatccgctccctcatggcggccattgatgcgcgaaaagaaaattag

SEQ ID NO: 2393 - DNA, 2682 bp, Unknown
  Artificiall/Consensus sequence
atgaaaaaactgatggtcctggatgggaattccattgtcaatcgggccttttacggcgtgagccagaacctgaccacccgggacggccagcccaccaatgcggtgttcggctttctggccatcctgaacaagctgctggacgagtgcgaacctcaggcactgtgtgtcacctttgaccggaaggcccccaccttccgccatctggcctatgagggctataaggccacccgcaaggggatgcccgacgagctggccagtcagatgcccatcctgaaggaggtcctcgcggccctgaacatccccatgtacgagctggacggatgggaggcggacgacctcatcggcaccatctcggtgaaggatactgccgccgggtgggagaccgtggtggtcacaggggacaaggactccctccagttggtgacagagaccaccaccgtcaagctggtgtccacccgcatgggccgtaccgccacccgggatatgaccccggagacctttcaggaggagtacggcttcgggcccatccacattatcgatctgaaagccctcatgggggatgccagcgacaacatccccggggtgaaaggggtgggggagaagacggccatggccctggtccagcggtatggatccatcgacctgctgtacgcggccatgccggagatcgagatggccgccggcaccccagccaagccgggagtggtcaaaaagctggccgagggggaggagatggcccgcatgtcctatgatctggccaccatccgcaccgacgctcccatcgagttcacaccggaggcaaacctgcgccgggagccggaccgggccgccctgtaccagctcttcctccggctggagtttgccaagctcatcgataaatacggactcaccgcaccccagggagagggggatacagagacggccccggtcaccggaacctgtgagagcgaggtggtggagagccgggagaggatggaggagctgcttgccctgtggcgggggctggaccaggtggatgtgctggctctgcccgggctggacaccgtgtgcgtggagtggcaggagagtgagagcctctcccgggcggcgctgtttttcgccggccggctggactgccacaaccagttcttgagggagctcttcgccccaggcatccgcaaggcggcccatggggtcaaggagatttggaaagccctgctggacgaggggatcgagcccggggacttcatctttgacaccgaagtggcggcctatctcctggcccctactgacggcagctacgagctggagaagctggggatgacctactacaaccaggagttccccaaggccgccgcctatctggaggagggggccttcggccccctggccgacccggcggccccaatgggcgccctgatatcccactgcgcccttatcggggccctccaccaaacgctgagaaagcggctggaggagctggacctgtggacgctgtaccagcagatcgagctgcccctctgcccagtgctggcggagatggagcgggaagggatgctggtggaccggggggcgctgatccgcttcggagagatgctctcccaggggatacagggggcccaggcagccatctttgcgctggcaggggaggagttcaacatcaactccacccagcagctgggccgcatcctctttgaccagctgggactgcccccggtgaaaaagaccaagactggctactccaccaacgccgacgtgctggagaagctgcggggccagcatcctatcatcgagaccatcctggagtaccggcagctgaccaagctgaaatccacctatgtggacgggctctccaaggtgatcggggcggatgggcggatccacacctgcttccagaacacggtgaccgccaccgggcggctcagctcggcggagcccaacctccagaatatccccgtccgcaccgagctgggggcgcagctgcggaagatgttcgtggcgggaccgggcaaggtgctggtggacgcggactactcccagatcgagctgcgcctgctggctcacatggcggaggacgagcacatgatcggcgccttccgtaccggggaggacatccacacgatcaccgcctcccaggtgttcggagtggagccggaccaagtgaccggagagatgcgccgccgggccaaggcggtaaacttcggcatcgtgtacggcatctcccccttctccctgtcccaggacatcggggtgtcggtggcggaagccaaggagtatatggatcgatatttcctgaagtatgccggggtgcgggcctatatggaccgggtagtggagcgggccaaggaggagggctatgtctccacactgttcggccggcggcgctggctgccggagctgaagtcctccaacttcaatacccgctccttcggggagcgggtggccctgaacatgcctattcagggaacggcggccgacatcatcaagctggccatgctccgggtgcgggaccggctgagtacggaggggatggagggccggctggtcctccaggtccacgacgagctgatcgtggaatgcccggaggaggaacaggggcgggtgtgcgccctggtggaggaggagatggagcgggtgatctccctgtctgtccctctgctggcggagacttcggcgggcaagagctgggcggatgcccactga

SEQ ID NO: 2394 - DNA, 4530 bp, Unknown
  Artificiall/Consensus sequence
atgaacagagaagactatcagcagcgcggcttgtatgacccggcgtttgagcacgatgcctgcggcatcggagccgtggtggacatcaagggccgccagagctatgagacggtggacagtgcgctgaaaatcgtggagaagctggagcatcgagcgggaaaggacgctgagggaaagaccggtgacggcgtgggcatcctcctccagatctcccaccagttttttcagaaggcggccacggagtgcggcatccagctgggggaggcgcgggactatggcgtaggtatgtttttctttccccaggacactctcaggcgcaatcaggctaagaagatgttcgaggtcattgtggccaaggaaggcatggaatttctgggctggcggaaggtgcctgtctgcccagaggtgctgggccagaaggcactgtccaagatgcccaacatccagcaggccttcgtgaagcggccgggggatgcggcccggggactggagttcgaccgcaggctgtatgtggcccgccgagtctttgagcagtccaacgacaacacctatgtcccctccctgtccagccggacagtggtatataaggggatgttcctggtgggggaactgcggaagttctacctggacctgcagagtcgggactaccacagcgccatcgcatgcgttcactcccgcttctccaccaacaccaatccctcctgggagcgggcccaccctaaccgcctgatcctccacaacggcgagatcaacaccatccggggcaacgcagaccggatgctggcccgggaggagaccatgtccaacccggtgatcgacgacgccctggacaagatctaccccgtggtcaacggggccgggtccgactcggccatgctggacaacaccctggagttcctggtcatgagcggcatggacctgcccctcgcggtgatggtcaccatcccggagccctggaccaaggacggcagtatcagccgggccaagcgggacctgtaccagtattacgccatcatgatggagccctgggatggtccggcctccatcctgttctccgacggcgacgccatgggagcggtgctggaccggaacgggctgcgcccctcccggtactatatcactgacgatggtaagctgatcctctcctccgaggtcggtgccctggacctggaccccaggaagatcgtgaagaaatcccggctggagccggggaagatgctgctggtggatacagtccaggggcgtatcattgatgacgcggagctgaaggagacctacgccgcccgccagccctacggcgagtggctggaccggggcctcatccggctgaaggacctgccggtccccaacaaaaaggtgcccggctactcccaggaggagctgacccggctggagaaggccttcggttatacctatgaggatgtgaaaaacaccatcctccctatggcacgcaccggggcggagcccaccgccgccatgggggtggacatcccactggcggtcctctccgaccacgaacagcccctgttcaactacttcaagcagctcttcgcccaggtgaccaatccccccatcgacgccatccgggaggaggtggtcaccgacaccaccgtctatctgggcaacgacggcaacctgctggaggagcgggcggacaacgctcacgcccttcaggtgggcaaccctatcctcacctcggtagacctgatgaagatccggggcatgaagcagcccggcttccaggtggagaccgtctccatcctatactacaagaacacccctctgaagcgggcgctggaccacctgttcgttgcggtggaccgggcctaccgcaacggggctaacatcgtcatcctctccgaccggggggtggacgagaaccatgtggccatcccgtccctgctggctgtctcagccgtggagcgatacctgatccgcaccaagaagtgcaccgccgtgtccatcgtactggagtcagcggaaccccgggacgtgaaccacttcgccacgctgctgggctacggtgcccgggcggtgaacccctatctggcccatgcggccatcggctccctcattgaccaaggtctgctggacaaggattaccacaccgcggtgaaggactataaccaggccatcctcagcggcatcgtgaagatcgcctccaagatgggtatctccaccatccagtcctaccagtctgcccagatcttcgaggcagtgggcattgaccgggtggtggtggacgagtatttcactggtaccctcagccgggtggggggcgtgggtctgaaggagatcgctcaactggtggatgaccaccacagccgggccttcgaccccctgggcctgggcggcgaccctaccctggacagccggggcgagcacaaggcccgcgctggtcaggaggaccacatgtacagcccccaggtcatccatctcctccaggaggccacccgcaggggggactacaaactcttcaaggagtacacggccctggtggacgacgcctccaagccccacaccctccgcggcctgatggagatgcagtatctggacaccccgattcccttggacgaggtggagagcgtggactccatcgttaagaggtttaagaccggggctatgtccttcggctccatctccgctgaggcccacgagtgcatggcggtggccatgaacaccctggggggcaaatccaactgcggggagggcggcgaagaccccgcccgcttcggtaccctgaaaaattccgccatcaagcaggtggcctccggccgcttcggcgtgaccagcgagtatctggtgtccgcccaagatatccagatcaagatggctcagggggccaagcccggcgagggcggccacctgccggggaagaagatcacgccggaggtggccaggacccgccattccacaccgggcgtcaccttgatatccccgccgcctcaccacgacatctactccatcgaggatctggcccagctgatctacgacctgaagaatgccaaccggcaagcccgcatctctgtgaagctgtgcgccgagccgggagttggcaccattgcctccggcgtggccaaggccggggctcaggtagtactgatctgcggctatgacgggggcaccggtgccgccccccgcagttccatccattctgccggtgtgccttgggagctgggggtggccgagacccaccagaccctgatcatgaacggcctgcgctcccgggtcatcgtagagaccgacggcaagctgatgagcggccgggacgtggccatcgcctgcatgctgggggcggaggagttcggctttgccaccgcccccctggtcaccatgggctgctgcatgatgcgggtatgcaacctgggcacctgcccggcagggatcgccacccaggacccggagctgcggcggcgcttcaccggaaaaccggagtatgtgatgaacttcatgcgcttcgtggcccaggagctgcgggagcacatggcctgcctgggggtgcgtaccgtggacgagctggtgggccgcaccgacttgctgaaggtgcgggagcacgccgtcaacgagcgggccgccacggtggacctgtccgccattctggataacccgtttgaaggggcgcaggtcaagcgccatttcgaccccgcggacgcctatgacttccagctggagaagacggtggacatgagggtcctgctgaagaagatgaagggggcgctggagaagggggagaagcggacggtgaacgtccccgtcaccagtaccgaccggaccctggggaccattttcggttccgatatcaccaggctccacggcagcagcctgcccgacgacaccttcactgtcaagtgtaccggcggcggtgggcagtccttcggtgccttcattcccaaagggctcaccctggagctggaaggggactgcaacgactatatgggcaagggcctctccggcggaaagatcatcgtctatccccccaaagggtcccctttcaaaccggaagagaacatcatcatcggcaatgtggccctctacggggctaccagcggcaaggcattcatcaacggcatggcaggggagcgattcgccgtgcgcaactccggcgcctgcgcggtggtggagggcgtgggcgaccatggctgcgaatacatgaccggcggccgggtggtggtgctgggacctaccggcaagaacttcgcggcgggcatgtccggcggcatcgcctatgtgtgggatgaggaccgggacctgtacctgcggctgaacaaggcgctggtcacagtggacccggtgacggagcggcaggacatccaagagatccggaccatgctcaccgagcatgtggaggccaccggctcccctaaggcccgggagatcttggaccacctggaggagaaggcagcctgtttcaagaagattctgcctcgggactacgacagaatgctgcgcaccatcgcggaatttgaggcccagggcctgagccacgaacaggctgaggtggaggcattcagtgccagcaccaaggaataa

SEQ ID NO: 2395 - DNA, 4995 bp, Unknown
  Artificiall/Consensus sequence
gaggaggaacacgcccactctctggacagctgctacagccatgactgtgtacatgagcacgatgacgactgctatcccacacagtgggtgaagtgtacgaaggaggacaacccggaccattatggtagcttcgggctccataaaagtgatactgagtgcacacttcactactttgggggcttcgattacacatggggataccaagtaattgacaaaaccgaaggccccaccgagtgcaggcacgaatgttctctcaaaaccggatgttacatatcgacctgcagcaaggaagagcaccagcatggtgactcctgctaccagtggacctatacctggacgctggaggaaaagaccgatgagaatgaacgtggggaccagtggcgcaactggtggcccgtgtattggagctttgacgaatatcacggatggggtaatgaagagatcacggacccctctctggtaacggtgtccgccggggcgaaggatgtcacttatacagggaaagaagtatcccctcaggatgccctggatgattcggaggcggccaacgcgggccaactgatccgcagcggcctggacatccgggtggcggagggctactatctctcctcctaccgtctggtgtgcggaaactataccgggtgcggtgtggtcgaatatggtgacgctgtcaccattgagccggacgaaaacggggattattccgctgtaacgcacgtttccattgacgaaaatgattttgatcattggcgcaatgtcggcggcttaggccgaaactatcccacctcaaaacctagtgaagccaactggagcaacagctatctaggcgggaacaccatttatcccttctatctgctgctggagttaaaggaagatgagaacacctatcagatccagtatgattggggcgaccaaagcgaggcactgactgagtacgatgttcctgaaactcagaccggtctgaagcgcaatgaggaagtccaagccgccattccttctgacgaggcggtccaggccgcgctggctacgggctatgtcttcgacggctggaccatttccggaacaggatatgaggacggctccaaggtggacgcaggcggaaaggtcgtcatccgcggcagcgatctgaccctgaccgccaagtgggtggaggccgggacgcctgaatttctgaacagcatcaaagtcaccgtgagctgcaccaaccaggccgcgggccatgcaggttctcagccgatgaccttgacggcaggggattataccacatcctcccgggtggtggaccgccatctggaatatacggtcaccatttcctctgagcgcttcgtgacggcgtataatgagaccaccggtgcgactcacacccccgcgaaagatacggccacagtcacttatgtgtatcacaacggctggaatctgaaaagcgggagcaacgaggcggtcacgttccaggtggtctgtgaggaccagtacacggtgaccgttaaatatgtgatggatgatgcggatcaaacggagatcaaaacttcttatgtcagcgaagagatgtccaaggggtctccctatgatgtgagcggccagatccctgactcgatcacatatgaaggtcagagctatgccaaagacacggtgaagggggcgacctccggcacgctcaccggcaatgtggagatcacggcgatttacagcctggatgaagtcggcggcgagaatggcggcgacggtgtcccggacaagtaccagaagaaagtgaccttccaggtggtaaacgggacctgggaggatgacaccagcgccgccaaagtcacctatgtgacgctgatgaaggacggcaagtgggacatgaacggcagcgcctacctgacagcccccaccggaatgaagccggacgctggctatggtggcacggacggaacgcagggcggctgggataccacgcctcctgccacagtttccgggaccgatgatgtgacgtacacctatacctttgccaaaagcaccacccccattgtccccggcaatgttctgtatgttgtggagcactacaaggcaaacgacgatggaacttatcctgtgtccgcgacggagacggagcgcttctccggggcgatcggggcagaggtaacggccaccccaaaagtgtatgaggggtactgtctggaccctgcgctctccaatacgaccggtacgctgaccaaaattgagaagccggaagatatcgtgacgctgaagctgtattacgccgtggacaaagtcggcggcgaagatggcggcgacggtaccccggatcagtaccaggcccaagtgatctatcaggtcgtggggggcacctgggcaaacggaagcacggaaattgaacaggtctatcatttgtcggaatatgatgagacctctgacaaatgggtcgaggtcagccccacgccgactttgacgaatattcctgacaccacaaaagttgagcctgatgcagcgcacatcctgagcggcgcgtgggatgatgagtcccccgtggccggggcggcattgacggcggggaccagcaccacctacacctacagacttactgcggcggcacccgccatgacggtggagaaaacagctcaggaggcatctgtccgtgtgggagagcagatccactacacgatcacagtgcgcaataccggcaatgcgcccctgactgatgtgacgattaaagacaccctgtggagtgccggcacggtgatccgggtaggggacatcgatcataccctcagcgacagcagctacaccatctccagcattggagtgggcgacaaggtcttcatcacctatgcctataccgcggcgcagacagacgtggcggcaggcgtgacgaataccgctgccgtgaccgcagatgagatcgaggacgcagttacagatacgactgatccggtgccggtgaccgcttactccctgacctatgacgccaacggcggccgcatcgccggggagaccacattcgtagtcccggacctggcccagcagactggttatgagctgggggaagaggatgactacaccgcccccacccacactgacaccgagggtacagcggtcctcttcctgggctggaccaccaccgacaaccatgagaagatctatgacgcgggcgaacagctgcccactctggtatccgaagtcaacatcccggcggtggccacggtctacgccgtgtgggcctatgaccggaacggcgacggtacccccgacgcccggcagatcatgatccagcccgccgatatcaccatctacaccggcggcagcagctatgagagcgtggtcaacggcagcggaaacgagatcggcgccaccgacaacggactgcccgtgccaggcttctacatcaccctgcccagtgatttgaatgagcggctgatcgaacacgcagatcccgccgatgttgtcaccactgaaaatggacagcaggtggtggacctgtccaaatatctgacctttacttacaacttcggcggagaacagcggatctggaagctggagcggtacgacaacaatcccggcaacaccagcatggcctatgaccgctacatctaccgcatcctgcccgctgagacccccaatggtgaggtccccatccgcctccagttcaccgatcaggatgaccctgattccttcatgaccagtgacgactttactgtccaggtgaacagcgtgttccggcagtatgacatgaccatctatgccggagatctggagcagcagcgggtcaaggccgagcttacggtaggcgcagacacggagcagtacagcgcggcagtgggatccggtacgctgaccatccggggcgtgactgatctcgataccgccaccacccccgtggtcaatgagccccccaccaatgaggtgaacagcatcaccgcccatatccccgcagacgccgctctctacatcaatgagagcaggctggaggtcgctgatcctgatgctgtgcatctgctggtggacagcatcgtccccgaccagggcaataccctgcacaacagcgcggtggatggattcaactccatcaccgaggaccacagcgcggagctgcgctacctggacctggtggacaccagcaacggcaacgcctatgtcaccaccgacggggagatcaccctctactggccctaccccgatggaacggatcggaacagcgagttccagctggtccactatgcgggcctggaccgcaacagcaacaccgacctggagcaaggcaactacaccatggagctctactccactgaggacggcaccctggtggccacggatgaaggcatccgcttcactgtggactccttctcccccttcgccctgttctgggaggatgaggatgacgatgacgaccgggatgatgacgatgatgacgatgacgacgacgaccgcgggcacggcggctccggcggaacacctcagctgaacaaggaggaccacttcgcctacgtctccggctaccccgacggcaccgtccagcccaacgaccccatcactcgtgaggaagtggccaccatcttcttccgcctgctcaccgacgtgtcccgggcggactacattaccgagcggaaccccttccctgatgtggagtccagccgctggtccttctactccatcaccaccctgaacaacggcggcatcatgaccggccgcaccggcggcgacttttacccccgcgcctacatcacccgtgccgagttcgctgtggtggccgcccagttctccgacgcccggtactccggcccggacaagttcagcgatatctccggccactgggcccgggagtacatcaaccgcgccgccgctgagggctggatcgccggttatcccgacggcacctacagccccgaccggagcatcacccgcgctgaggtcatggccctcatcaatgaggtgctggaccgcgcccccgacgccgatcacatgctggacgacatgatccactggccggacaacccggaggacgcctggtactatgaa

SEQ ID NO: 2396 - DNA, 1791 bp, Unknown
  Artificiall/Consensus sequence
atgatcgatttgcttcagttgtttctgacccacctgcagggctacaagcggcaggcggtctggtctcccatcctcatcgtggtggaggtcatctgtgagctgctgctgcccctggtcatggcagagatcgtggatacggccatcccagccggcgacgagacttacatttttcagctgggtgcggtgatgctggtgctggcgggcgtggccatgctgtgcggtgtgctggcggccaagtattctgcctttgccagccagggctttggcgccaatctgcgccagtgcctcttcgacaaggtgcaggagttctcctttgcggacattgaccgtttctcctccgcctccctcatcacccgtatgaccaacgatgtcaatgccatgaccatgatgctggccatgggtctgcggatgctggtacgggctccagtgatgctggtggccgccctgtgtatcagcttctatctgaacgccaggctggcactggtgctggtggtggtcattcctctgatggtgctggtgatcggcattctgatgaaggtgtgcaccaagctctttgagaccatgcagaccaagatcgacaacctgaacaatacgctccaggagaatctggtggccatccgagtggtgaaggcctttgtccgggagggctacgagcgcatcaagttcaagaagtccaacgatgagctgatggacgccgctctggcagtgggcctgcggatcattgcgatcatgccggtgatgatgctggccctcaacggggccacagtggcggtgctctacttcggcggaggcatggtcatggggggcacctttgaactgggcgacctccaggccttcatcaactacatcgtgcagatcctcatgagcgtgatgatggtggccatgtccctgctccagctctcccgggctcaggcctgcgcccaccgcatcaaggaggtgctggagacagagccctctgtggagaacaagccggagggggagatctgccgggcggccctccccggggaggcggcggacggaacggaccacgtcctgcccgcccccaggggcgaggtggagttccgggacgtctccttcaaatatgtggcctcgggcagcggggacgacgtgctctcccacatcagcttccatgtaaggccggggcagttcgtggccatcgtgggcgggaccggcacgggcaaatccactctggtcaacctgatcccccggttctacgatgtcaccggcggccaggtgctgctggacggggtggatgtgcgggactaccccctggaggagctccggggccgcatcggcatggtgctccagaccaacatcctcttttccggcaccattcgggagaacctgctgtggggcaacccggaggctacagaggaggagatgatccaggcggccaaggacgcccaggcctatgacttcatcatgtcgttccccgacggcttcgacaccagcctgtcccagggcggcgtcaacgtgtccggcggccagaagcagcgactgtgcatcgcccgggccatgctccgcaagccggcggtgctcatcctggacgactccacctctgccgtggactcagccacagaggcggccattcgggagtccttcgccgccaacctgaaggacaccactgtcatcatcattgcccagcggatctcctcggtgcagtacgccgatgagatcctcattctggaggatgaccacattgcggcccggggcacccatgaggagctgctggctaccagtcccatctatcaggagatctatcagtctcagcaggaaggagttggtgaataa

SEQ ID NO: 2397 - DNA, 2187 bp, Unknown
  Artificiall/Consensus sequence
atggcagcacgaggggagaagaaaaaattgttcaaaaaattgaagctcacgacaaaattgactctggtcatcagcgcggtcgtgatggtggtattcgcggtcctcatcaccataactgtcgttacgtccagggccagcatttacacggggatctccggcgagcttgcctcaatcgcggagttcaacggcggggagattcagagcgggtttgacacagtggagcgggcggccctgggcatccaggactacataggacgactttacagcggccaggtcacggaagaaggcgacgctgacctgcagcagagcatgctttatccagggagagctctgacgtccgccgcctataatctggaacaatttgtcgtagagaccgcccgaaatacagtgaaaaacacccccgagatcaagatgctcggcgttatgtttgagccctaccagcttcagagcgatatggaagaatacggattttacgtcaccatggatacagcggatacttccattcatatctatgacgcctacgagggatatgcgaaagaggactcctaccgcattcccgctggagagggacatccctacatctcccagccctatcaggatggagatggcatggtggtggcctatggcacgcctatcacctacgggggacgggtcgtaggtgtggtgatcaccagtgtggacctgggcgccttttcttctgtaaaaaccacaagtacgaattatgattccatgtgggccaccctgttcaatcaggatgggatcattgtctggaacagtaaaagcgcggagtccaccgggctcaatctgtctgatatggtgccagaccctgaccggctggaggagctgaggtccctgatggcccagggaactgcttttcaggcggagatacccgctgaggaaggaaaaaatatttcctgcttttttaacccacttcaggccggggacgagacttggtggtctatgaccggcctctacaccgccgacgcggagagcaccctggtccagacgacgcgcctgctcctgctcctctccctggcgagccttttgctgatcctggccgttgtgatcgtagttctccggcaaatgctgcggcctgtccagagggtggccagggccgcagatgagatcgccagcggtaacttggagatccagctggatgtcagccgtcatgatgagatcggactgctcgccggttccttccagacgatgacagaaaacctgagggcgatcattcaggatatcgactatatgctggatgaaatgagcgtgggaaatttctgcatcaatacccgggaggaagcgcgctatgtcggggagtacgggcgtatcctggattcgatacggcgtatcaaccggacactcagccacacattgaggcagatcgatggcgcggccaatcatgtcttttctgggtcagagcaggcatctgtaggcgctcagtctatggcgcagggcgccacggagcaggcatccgccattcaggaactggcggccacggcctctgacattttggagcatgtacaaagcaatgcggagcatgcgcggaatgtcagcgaaaaggcggtgacggtgggccgtgaaatcgtggacagcaaccagaagatgcaggagtcgctgtccgcaatgacggagatccggcgcagctccggcgaaatcggaaatatcatcaagacgatcgaggacattgccttccagactaacattttggccctgaatgcagcggtggaggctgccagagccggcactgccgggaagggatttgccgtggtggcagaagaagtacgaaatttggcgcagaagtcctctgctgcatcccaggacacagcagagctgatccaaaggtctctgtcagcgatccaacagggcacaaccagtatgaatgagacggcggaatatatgcagagggtagtccagagcgcacaggagatcacagagacgatccagcagatatccgaggcgtccgatcagcaggctgaggctctggctcagatcacccagggcgtggaccagatatccagtgtggtccaaacgaattccgccacagcagagcagagcgccgcagcaagccaggagatggcgaaccagtcccgaatcctgaaagagctgaccgcaaagtttcagttgagggatatagaggatgaggtggacaatgtaacaggggcagaagcacagcacggacgagcctga

SEQ ID NO: 2398 - DNA, 2310 bp, Unknown
  Artificiall/Consensus sequence
atgcagcccaccatgtgcagccgctgccacaagcatgtggcggtggtctttatcaccaaattggaaggcggccagtccaagaatgagggactgtgcctcaagtgcgccaaggagctgggcatcaagcccatcgacgacatgatccagaagatgggcatcaccgacgaggacctggaaaacctcaccagtgagatgatgtccgccttcggcggggccgaggggatggagggactgatgccccaggaccgggaggacggagacgaggacgacggacgcaccgccaccttccccttcctgaaccagcttttcggcgccgccgccggcggggacgccgagcccaagaaggacgccgccccccggccggacaagaacggcggcaaggggcaggagcgccccgtgaagcggaagtttctggagaactactgcatctccctgacccagcgcgcccaggagggcaagctggaccggctcatcggccgggagcgggagctggagcgggtcatccagatcctcaaccgccgccagaagaacaacccctgcctcatcggcgagcccggcgtgggcaagaccgccatcgccgaggggctggccatgaagatcgccaagggcgacgtgccctataagctgctggacaaggaggtctatctgctggacctcaccgccctggtggcgggcacccagttccgcggccagttcgagagccggatgaagggcctcattgaggagatcaaaaagctgggcaatatcatccttgtcatcgacgaggtccacaacatcgtgggcgccggcgatgccgagggctccatgaacgccgccaatatcctcaagcccgccctgagccggggggagctccaggtcatcggcgccaccaccctcaatgagtaccgcaagcacattgagaaggacaccgccctggaacggcgcttccagcccgtcatcgtggaggagccctccatcgaggacagcgtgcagatcatcgagggcattgccccctactacgaggcctaccaccaggtcgtcatctcccccgagatgtgccgcctggccgtcaccatgagcgagcggtatatcaccgaccgctatctgcccgacaaggctatcgacctcatcgacgaggcctgctccaatgtgaacctggagaaccgcactctggcccgccgggccgaggtggataaggagctggccgacctggacaaggagaaagaggtcatgatggccgccgccaccgaggagtcctatgcccggcttgccgccatccgcagccaggagcttcggctggagcaggagaagggacagctggacgccgcccccacccccgccctgacggtggagcatctggccaacgtcatcgagctgtggaccaagatccccgccagccagatccaggaacgtgagtaccagcgcctggcccggctggaggagcggctgaagcagcacatcatcggtcaggatgaggcagtccacgccgtctcctccgccatccggcggggccgtgtgggcatcagccccaagcgcaagccggtgtccttcatctttgtgggctccaccggcgtgggcaagaccgagctggtgaagcagctggcccacgacctgttcaacacgccggagtccctgatccggctggacatgtcggagttcatggagaagcacgcggtctcccgcatcatcggctcccccccggggtatgtgggctatgatgaggcgggccagctgacagagaagatccgccgcaagccctactccgtcattctcttcgatgagatcgagaaggcccaccccgacgtgctcaacatcctgctccagatcctggatgacggccggatcaccgacgcccacggccggacggtgaactttgaaaatacagtcatcgtcatgacctccaacgccggcagcaacaccaaatcgggctctgtgggcttcgcccgcaccgccaatgaacagggcagggagcgggccatgaaggctcttcaggagttcctgcggcccgagttcatcaaccgggtagacgagatcgtctacttcaaccagctcacagaggacaacttcaaggccatcgccgccctgatgctccaggagctccaggactccctggccgagaagggcatcgtcttcacctggcaggacagcctgctggactatctggtgaaaaagtcctattccgccgcctacggcgcccgcaacctgcgccgcctgatccagaaggagctggaggatgctatcgcctcccgcatcatcgacagctggcagcacccggtcgcccggctggatgccgcctccgacggcgagcagctggtcctgtccgccctgtaa

SEQ ID NO: 2399 - DNA, 2508 bp, Unknown
  Artificiall/Consensus sequence
atgacaaaacggatcttatctttggcgctgacgctggccatggtgctgtcgctgtgcctgacggtccaggcaaagggctctgtgaccgtcactttggacggacgggccctggagctgaccgctcctgcctatgtggacgggaacggcaggacccaggtgccggtgaccatcggcccccagctggggctgacctaccagcagaaggagggtgaggtcacctttgtaaagggggaggccagcctgaccttccgggatggggagaagcaggccggcagtatgaccatggacaccgccgccgatctgtccggcagcgtaggctatgtgcccctggcctacctggcccgggctttcggcttccagctgatttggaacagcgggacccggacagcggccctgaccacgccggtggagggcttccaggcccgggacctggcggagatcgaggccccggcccacgattacagcgagagcaaccagctgcctctgaccggatacttcaaggcatccctcaccggtgagtttgccggccgtgaggtgcgctactacatccccgacacagcggtgatccgcccctattaccactttatcgccgtgcccgacggggtgaacgcggaccagttcctggtggacagcggctggaagcaggtggcggatgagaccggcgagtgtctgttcgtcctgctgcctgatcagaccacctatatgtggggagatgtggagcaggagaaggactatattgccgccgccaaggcatatcactccggcaatggcgcctatttcaccaccttcggtgagttctatctggtgggctatggagccggcgcagcccccctggaggcctgggctgcggagaacccccatctgatcatcagccaggcctatctcaacgggacgacgtatggcctggagaacctccgggcggccggagaggagtcctacggatggaagcacatgaccgacggggatatccgggaccgggacggcgacggcatcaacgagcgggtggatgagaacggcaaccagaagatcctgtatcagatggcggaccggctggatcagatcctgaacccggacaaggggagcgaagcaggccttctgaccaagggtgatatgccccttcccacctggctggtcaacgcggagtccgacgacagcctgacctactggaagcaggtcaaccgggcggacagcgcagacgccagcgtgacagcactgggaagcgttccggtgagcgggcaggtatacagccagaaggaggacacctgggccaccgagtatgcgggccggatctccaaggtggtggatctggagaccgccgcagacacggtctcttatgacttcacccgtgctctgcgggacgagatgaccgactacacccggtatgacaactccatctcctacggcaacggcctgacctaccggctggattataccgacatccaggtggagcgcttctcctcccgggacaagcgggcggtggggaccgtcagcggcccggatctgaacgggaacgaggtggaggctgagatcaccatccaggccctgaccctggacgacggctatgtgacagacgtgctgctctatgtgccggagacagcggggacgaaggacatccccgtggtggtggtatggcacggcggctctcagaccgggcacctgttcatggattccactgcctggtggcagaccgccgcggcggagggctttgccctggcgctgcctacccgtaccaaccacaaccagggtacatcctccgactatgacctgcccatcttcgacaaggtggtccagtatttgaagaacgacggccgcttcgatatgggccggatctataccaccggccagtccatgggctctgtggccaccatcgcgctggcggagaaccgggcctcccagctggccgcggtgatctccagcaatgccggcgggcccagccgtctctccggcggcgacgccatccccgccggactggtggtgggcgaaggaaactacgccgaccggggcatccccggctatacggccgacaccagttatcccgaggacgacaccagcgtgctggtgcgctccactgaggctgccgccgcgggcgccgacatctactgggacgcggccaagaacctgaagggcgcgaccaatcacaacatgaacgactggatcgcctatttcaccgatgccaacggcctgggcgaggacagcctgagcgatgtgatcgtgtacagcggcggaaacgccctcaacggcggccacgatgatgcccagggcagcctgagcgattgggagagcaacaacgcccgctaccgtacctggaagtggtacaatgaggatgacatccccgtgatgacctacatcttctctctgtacgaggcccacaactgcatccccggtttccggccgctgatgtgggacttcctggagcattacagcgtggagaccgccgccgacggcacggtgacccgctattacagtgcctccgggtttgaacaggacgacgcggtcgtgatccagtga

SEQ ID NO: 2400 - DNA, 2622 bp, Unknown
  Artificiall/Consensus sequence
gtgtttcccttgaaacagaaatttgacgtcaccggtatgacctgctccgcatgctccgcccatgtggaaaaggcggtgaacaagctggagggcgtacgcagggcggaggtcagcctgatgaccaactccatgaatgtggagtacgacgaggccgcccttgcccccgaaagcatcatccaggcggtggtccaggcaggatacggcgcctccctgcccgcccaggctggggtcccagcccggggagccgctaagaggccggaggcccagatggaagcggagctctcctctatgaagcgccgcctcatcctctcctttctcttcctgatccccctgttctatatctccatggggcacatgatgggcgcccccctccccgctttcctggtgggtcacgagaacgccatatccttcgcctttacccagctcctgctcaccctgcctatcctgtatatcaacgacaagtactacaaaaacggcttccgctccctgctccacggcggccccaacatggactctctcatcgctgtgggctccatcgcggctgtgatctatggcgtctttgccatttaccagatcggctacggcctgggccacggggacatggcccgggtggagcagtaccatatggacctgtacttcgagtctgccggcatgatcctcaccctcatcaccctgggcaagttcctggagacccgctccaagggcaagacctcccaggccatctcccgcctgatggacctggcccccaagacggctaccgtcctgcgggacggggccgaggcagagatcccggtggaggaggtccgggtgggcgaccgggtagccgtccgccccggccagtccatcccggtggacggtgtcattgtggagggcagctccgccgtggacgaatccgccctcaccggcgagtccctccccgtggacaaaggccccggggacaaggtggccgccgcttccatcaaccgctccggctacttcgtttttgaggccagccgggtgggcgaggacaccaccctggcccagatgatccggctggtggaggaagcctcctcctccaaggcccccatctccaagctggccgacaaggtggccggcgtctttgtccccaccgtcatggtcatcgccgccatcgctgccggggcctggtggttcgccactggcagcgccacctccgccctcaccgcgggcgtggccgtactggtcatttcctgcccctgcgccctgggtctggccacccccgtggccatcatggtgggcaccgggaagggagcggagcagggcatcctcatcaaatccgctgaggccctggagaccctccatctggtggataccgtggtactggacaagaccggcaccctgacccagggcaggccggtggtcaccgacatcctgccgggcgaggacatggacgaggagggcctgctcatcctggccgcctgcctggagggcccctcggagcaccccctggccgccgctatcgtggaggagagcagaaggcgtggcctccccatcacctcggtgggcgggttcaccgccgtccacggccggggcgtccgggccgccctgggagaccgcacctgcatgggcggcaaccgcgccatgatggaggaggccggggtggagctgggctccttccccgcacgggccgaggagctggccgcccagggcaagacccccctctactttgccgacgagcaccgggtgcttggcctggtggctgtggccgacacccccaagcctaccagcgcccaggcggtagccgccttccagcggctggggatcgacgtcatcatgctcaccggcgacaaccagcgcaccgccggcgccatcggcgcacagctgggcgtctcccaggtgatggcggaggtgctcccccaggacaaggagcgcaaggtgaagcagctccaggatcagggcaagaaggtggccatggtgggggacggcatcaacgatgccccggcgctggcccgggccgacgtgggcttggccatcggtgctggcaccgacgtggccatcgagagcgccgacatcgtgctgatgaagtcggacctgctggacgctgccgctgcggtggaactgtccaaggccaccatccgcaacatcaagcagaacctattctgggcctttttctacaacagcctgggcatccccctggccgccggcctgttctatgccctggggtggacggatgtcatgctcaaccccatgttcgccgctgccgctatgagcctgagctcggtatgcgtggtgaccaacgccctgcgtcttcggttcttcaagcccaagagcgtccctgcctcccctgttccctgccccagcggcacctgcccggtccagcctgtccctgacccctcggagcagcccacatatgaaccacaacatcaggaagaacgaaaaggagcgaatgaaacgatggaaaagaagatcatgatcaacggcatgatgtgcgcccactgcaccgcccacgtggagaaagccctgggcaccctggagggggtggcctccgtcaaagccgacctggagggcaagtgcgccacagtcaccctcactggtgcggtgagcgaccagtccctcaccgacgcagtcactgaggccggatacgaggtggtgtccattcagtga

SEQ ID NO: 2401 - DNA, 3582 bp, Unknown
  Artificiall/Consensus sequence
atgacaaaggaggggcgcaaagcagagggaagagaggaaatgcagaaaagagctctatccaatcaggagatcctgaaaagaggaggtcatcgatttatgcgaaccataacgaaacggctcctgtctctggtgctgacgctggccatgttgctctccctgggcctgaccgtccaggctgtcaacacggcggtaacggtcacgctgaacgggacggcactggagctggaagcgcccgcctatatcgacgggcaggaccggacccaggtccccgtgagcatcggcccccagctggggctgacctatcagcagaaggaaggggaggtcacctttgtaaagggagaggccagcctgactttccgggacgggtccaaggaagctggcggcatgactatggacaccgccgccgatctgtccggtgaggtgggctatgtgccactggcctatctggctcagtttttcggactgagtctgacctggaacggcgctgcccgcaccgctgcgctctccaccggctccgacctgactgtggcggacatccagagcattcaggcctataccgacgagaccatgtacggcaccggtgtggtggaggtgcaggtcacctataagccgggtgtcaatgtcagcggcgtcaccgccgacagctacatcctggaggaccggggctccctgtcccccgactacggtcggatcaagatcgctggtgtctctgtccagggccagactgtgaccttgacgattgacgacggctctgcagccaccgccaacaacaagctggtctacactggggatcagaaggaaggcccccgtgagcgcaacgtgttcggcatctatgccaccggcgcctggtaccgcgatgtgaacggcgtcatctactacggcaaggaagattccggcgagtacaaggccaacaccaccggcatgggttaccagagccgcgcgtgcctggagctgaagctgcgccacgccggcgaggctgagagcgccgccgcctgcctggccaacggcaagggccagtataacgccggcgggctgtggaaggagacggtggaccgccaggtcggcgctggtaagttccagtcctttgaggatctgggcatccggattccctctaccgccgcggcagctactgacggcacccaggacgcctatgtccggggctacgcctatatccccgccaactatgatcccgccaacggcatcgtgttcaccctgcagggacagggcatctcctactggaagctgcccgacggcaccgatgacgatggcaccggcatcatgtatgattccgccaccacctcctgggccaacaagggtgccatcgtggtcaacatccacgaccgctccagcgcaggccccggcgagtatttcgatatctatgatttcgtggtggacgatgtcaatgtgatgcagtatttcatcgacacctatggtgtgaccggcaacatcgtactccagggcaactccagaggcaccatggcctccgccttggtcattaaggctctggctggacaggcttacaacccccagaaccagaagaaggatgccggactggaggagaccagcactctgcccgagggcaagtatgacttcaccattgacgcctatatctgccagaatggtaccttcgggtacagctacgatgaggaggactgggccgccatcgctgctaccggcctgaaggtttgggccttcgacggagagcaggactccaacaacgtggagagcatcgctcagtacacccagatcatgaccgaactcaagggggccgactgggcgaaggagaacattcgtcttaccggttacccctctgagatctatgcctactggggtgagagcgaccactcccccacccgtatcaacggctggtactttgatgatgccgctttctatggccccgacttggaaatcgtggacggccagatcgtctacaataccaagctgagcgacggggatacttataccctggactgccggggcagcgccgccggcagtagcaagcagggctataagtacaccgtgtacgacgaactgtatcaggagtgggctctggacaagaaaggcgcctccgtcactgccggagctcccgccgctgaccagatcacctctatccaggccacagcagtggctaacttctatggctacaaggtgggtacagtggacatcacctacgccgcgggtactgacctgaccggcgtcaccgccgacagctacaccctgtatgaccggggcttcaataatccggagttcggcgaggtggagatcaccggcgcctctgtggatgggaacgtggtcaccctgaccgtcgatcaggggacggataaggtcaccgaccgcagccgtgagacttacggaactctgtgcaccagctccagctggtatgtggattcagaggggaacatccactatggcgatactcagaccactgatgccctgggtatcaccatctaccccaacaccattaaaaagggcctgcagtggagagagaatatggacctggtgctgtgcgtcaacagcgacgacatcaccaccggtatccgctccactgacggcgctggcactatgctcgccgataccgtctgggagcccaccatcctggccgatgacctggacaaggtggagctggagatggtggatgtaggctggaaagctgcagactacactatgctgggcgatcagggcgaggtccccgtccatgttatctaccccgacaactatgaccccaaccgggcggagccctaccccgtcatcgactatcagtgcggcggcggcgtctgctactgggaggtcactgacggcagcaccaccccggccaacaacctgggctgcaacgtggtctatgacgtgatgatgaccgagtggcaccgccagatgcctgacgccatcattatgagtgtcaacgtccactcctccacagtagagaattctgccaaggagatcgccggcgtgctggattacgccatcgagaactggaacgcggacaaggaccgcatcatcctggtgggcaactcccagggcaccctgatctcctccgacgtgatccgccagcgccccgatctggtggcgggctatgtggagtgcaacggcaacctgggcggcatggcatccgctgatgcggtggacggcaccctggcaaacagcagcctggggagctggaccgaggaagaggtccaggccatgatcgacaacgaggtgtccgtgtggatgttcaacggcgagaccgatggtgacaaccccgctgcccagcaggacgtgatcgagatcgtgaaggacctgtaccgggaagccgggaagagcgagtcctggatcgaggagcatgtccgggcctccgggctccagtcctggaagttcaaggattggggcgagaccgaccactccgttaccaaggtggtggcttggtactatttgggccagccctacatggatgtggagaagggcacctctctgaaggccggcgacacctaccagtattccggcaaggaggagagctacgagaagtatcagtacaccatggactatgtgtacacggtgtacccggagagcgtggcccagtgggcgaaggacgttttcgcctctgtgtaa

SEQ ID NO: 2402 - DNA, 2610 bp, Unknown
  Artificiall/Consensus sequence
atggcaaagaaagcccagtattctgtggtagacagcaaagagagcttcgaggcactgttgacccgggtccgtcaggcccagcaggagtttgcccgctattcccaggaacgggtggacgccattttcaaggccgctgccatggcggccaaccaggcccgcatccctctggccaaggaggctgtggcggagaccggcatgggggtcgtagaggacaaggtcatcaagaaccactacgcctcagaatatatctataatacctataagaacgtgaagacctgcggcgtggtggaggaggaccccgcctttggcgtgaagaagctcctggagcctgtgggggtgatcggtgcggtgatccccaccaccaaccccacctccaccgccatctttaaggtgctgctggccctgaagacccgcaacggcatcatcatcagcccccacccccgggccaagggatgcactgtctccgccgccaggctggtgctggaggcggcggtggccgccggcgcgccggagggcatcgtgggatggatcgacgtgcccagcctggagctcaccggcctgctgatggcggaggtggacctgatcctggccaccggcggaccaggcatggtgaaggcggcctattcttccggcaagcccgccgtgggcgtgggcgctggcaacgtccccgccatcatcgacagctcctccgatgtggccctggcggtcagctcggtgatccactccaagacctttgacaacggcatggtgtgcgcctcggagcagagcgtcatcgtcctggaccccatctacgaccaggtgaaggcggagtttgccgcccggggctgctacttcctgaaaggagaggagacggacagggtccgaaagaccatcctcatcgacggctccctgaacaatcagatcgtgggccagagcgcccaccgcatcggcgaactggccggcattcagacgcctgagaccgccaagatcctcatcggcgaggtggacagcgtggagccctctgaggagttcgctcacgagaagctctcccccgtgctggccatgtaccgggccaaggactttgacgacgcgctggacaaggccgaccgcctggtggccgacggcggctacggccacactgcctccatctacctcaatgcggtgactcagcgggagaagctggaccgcttcgcccagcggatgaagacctgccgcatcctggtgaacaccccctcctcccagggaggcatcggcgacctgtacaacttcaagctggccccatccctgactctgggctgcggctcctggggcggcaactccgtgtcggagaacgtgggcgtcaagcatctgctgaatatcaagaccgtggcggagaggagagagaacatgctctggttccgggcacctcagaaggtgtatttcaagaagggctgcctgcccgtggccctgcgggagctgcgggaggtgatggacaagaagagggcgttcattgtcaccgaccagttcctgtacgcaaacggttatgctaagccggtcaccgaccagctggaccagatgggcatcgcctatgacgtgttctatgacgtggctcccgaccccaccctggcctgtgccaagacgggcgcggagcggatgcgggccttcggacctgactgcatcatcgccatcggcggcggctctgccatggacgcgggcaagatcatgtgggtgatgtacgagcaccccgaggccgatttcatggacatggccatgcgattcatggacatccgcaagcgggtgtacactttccccaagatgggggagaaggccgccttcatcgccgtccccacctccgccggcaccggctctgaggtgaccccctttgccgtcatcaccgacgagcgctccggggtgaagtaccccctggcggactatgagctgatgcccaccatggccatcgtggacgcggacatgatgatgaacgcccccaaggggctcaccgccgcttcgggcatcgacgctgtcacccacgccctggaggcctacgcctctatgatggccaccgactacaccgacggcatcgccctgcgggccctccagatgatcttcacttacctgccccgggcctatgacaacggccccagcgacccggaggcccgggagaagatggccaatgccgccacgatggcgggcatggccttcgccaatgcctttctgggagtgtgccactccatggcccacaagctgggtgccttccaccacctgccccacggagtggccaacgccctgatgatctgccacgtgctccggttcaacgccgctcaggtcccggccaagatgggcaccttcccccagtatgaccacccccacaccctggagcgctatgcccaggtggcggacgccctgggcatccggggcgggaacgaccaggagaagctggataacctgtgtgccgccatcgaggagctgaaggcgcgggtgggcatcaaggccaccatccgggactacggcgtggacgagacgtatttcctggaccacctggatgagatggtggagcaggcattcgacgaccagtgtaccggcgccaacccccgctaccccctgatgagtgagatcaaggagatgtacctgaaggcctattacggagaataa

SEQ ID NO: 2403 - DNA, 2136 bp, Unknown
  Artificiall/Consensus sequence
atgggcgatttggaagatcgcagcgtcaacacggctcctgccggtgatcccagcgtagacgtgggaacggcggaggacgtggaagcggttatgaagaagtatgaccgagaatccaacacccggatctggaccggagtcccggagctggtcattcggatcatgctggctctcttttccctgttcatggtatggatgaacctgtttgccagctttgacaaccgcgtccggcactgcctgtttttgggctttatcattttgtttgtattcattctgtaccctgcgaaaaagggaacacagaaggtgaatcacatcccctggtatgacatcgtattggcagtggtgggcgcggcctgctactttaactatgtcatcaacctgaagagcatcgtggccatgatgacccggatcggcaccactgaggtggtgctgggtatcatcggcatcctgatcctggcggagtgctgccgccgggtggtgggcatccccatcctatgcgtggccacggccttcgttctttatgcttatctgcccatgtttgccggaaagacggtgcagagcattgtgtacaacctgttctacaccaccaacggcgtcattggcacccccatcagcgtgtgctgcacctacatcgtgctgttcatcatcttcggcgctttcctggaggccaccggcatcgccaacttcttcattgaaggggcaaacgccatcgcaggctccgcctccggcgggcccgccaaggtagccgtcatctcttccgctctgtgcggcatggtgtccggttcctctgtgggcaacaccgtgaccaccggcgccgttaccatccccctgatgaagaagactggctatcccccggagttcgcgggtgccgttgaggccgccgcctccactggcggacagatcatgccccccatcatgggcgccgccgctttcctcatggccgagatggtcggcgtcccctactctgagatcgtgatccgggccatcctgcccgctttcctgtacttcgcgggcatcttccttatggtccacttcaaggccaagaagatggggctgcacggtctgcccaaggactccctgcccaaggccaaggatatccttcccaagatctacctgctggtgccgctaatcgtgctggtgtacatgatcatcgtgggcttcaccatgtcccgcagcgctgtgtatgccaccttcgccgctatcaccatgggtatggtggaccgggagaagggcggcaaaaagctgctcatggccctgcccctcatccccctggctgtcatcgtgatcctgggcaacaagtcctacgaatggatcccggagaacctggataacatctgtatgggcctttgggtggtgctgttcgttctcttcacggtaatgagcaagcccaaccgtgaggcggccccctcctatgtggacgccttggccgccgggacccggaataccctgtctgtaggcgtagcctgcggcatcgcgggcatcatcgccggcgtggtgacgatgaccggtctggccaatgtgctcatcaccgccatcgtacaggtcgccaacggtcagctgatcatcgccctgttcctcactatgctgtgctgcatcgtgctgggcatgggcgtccccaccaccgccaactacgtcattatggccaccacttgtgcccctatcctggtgcagggcatgggcatggatctgatggctgccaacttcttcgtgttctacttcggcattgtggccgacatcaccccgcccgtggccctggccgcctatgccggctccgccatcgccaaagcgccgcctatgaggacggccttcaacgccacccgtctggccatcgcggccttcatcgtgccctacatctttgctttcaataacacgatgctgttcattggcgatttcggcccgctggacgtggtgcaggtggtccttacctcctcggtgggtatgttcctcatcgccgccggcatgatcggctacatgctccgggatctgaactggggcgtgcggatcgtgtgtatcgccgccggtctgatgctgatccatccgggcactctgaccgacatcattggtatcggcgttctggtcgtggtgctggtgttccagatcattaccggaaagggcagtaaggctgtcaaggcggcctga

SEQ ID NO: 2404 - DNA, 1809 bp, Unknown
  Artificiall/Consensus sequence
ttgcagaatattccggtattgaacatggtcttgatgtggaaccctgttggtacagttttcaagcatagcccgcgccgatcatcttatgatgtgggttatgctttttccatgccctttgtttcgctcctctcggcggaagctgtgttgattgaaggaggaatccctatgtctgtttcaggccttctgagtcttttgggcggtctcgcgctgttcctgtacggcatgcagatgatgagctccggcctggaggccgctgccggtagcaaaatgaagctgatcctggagcggctgactgccaaccgttttctgggcgtcctggtgggcgcgggcatcaccgccgtgatccagtcctcctccgccaccacagtcatggtggtgggcttcgtcaattccgggatgatgaccctgaaccaggcggtctggatcatcatgggcgccaatatcggcaccactatcaccggacagctgattgctctggacgtgggcgcccttgcccctctcttcgctttcatcggcgtggccatggtggtctttgtcaagatgcccagggcccaccacatcggccagatcatggccggtctcggcgtgctgtttatcggcatggagatgatgagctcctccatgatgcctctgcgtgactcccaggcctttgtggacctgatgaccagattctccaaccccctgctgggcatcgccgtgggcgccctgtttaccgccctgatccagtcctcttcggcctcagtgggcatcctccaggctctggccaccagcggtgccatcagcttttccagttctgtgttcatcctctttggccagaatatcggtacctgtatcactgcggtcctggcctccatcggcaccagccgcagcgccaaacgtgctactatcatccacctgatgttcaacatcatcggcacggtgctctttaccatcctctgcatcctgtttcccttggccgatctggtggcctcctttacccctgatgcgccggctgcccagattgccaacatgcacactattttcaatattgtcactacccttctgctgcttcctctgggcaatcaactggccagcctggcggtgcgtatcctgcccgagcagccggaggagaaccgggacgagatgcacttggaatacctgacccccgtccaggtcagcagcaaggacggcaacctgggcgcctccgctatccacatcggccagctgcagcaggagctggatcggatgctggatatggcccaggacaacatcgagaccagctttgacgcggtgctcagtcgggacagcagtcttctgaccaaggccgagaagatggagagctacttggatttcctcaataaggagatctccaagtatatctcccgtctcatcacctatgagaccaacgagcagggttccagcatcgtcagcagctattttaccatcaccggcaatatcgagcgcatcggcgaccacgccatcaacatctgcggctactccaagctgctggaggaacggcacatccagttctccgcccaggctcaggaggagatctgccagatgcgggacatctgtctggaggcgctgaacaccctgcatcagcgggaggctggcgacctgctctggctgacggacgtctctgctctggagcagcgcatcgatgacatgaccgacctgttccgcaaggatcagctggagcggatgaaggccgggacctgttctgatgaggcctgtatcctttactctgagctgctcaccgacttcgaacgcattggcgaccatgtcctgaacatcgcccaggagatgtccagcatccgggaacacagctga

SEQ ID NO: 2405 - DNA, 2358 bp, Unknown
  Artificiall/Consensus sequence
atgatcctgtcggtgggcaaccagtccggggcggtgaagcgccgcctggtggacatggggctgactcccgggactgtggtgaaggtgaccaagatcgcccctctgggcgaccccctggaagtgagcctgcgggggtatgagatgtccctgcgccgggcggacgcggcccagatccggatgggacagcccaggaggacggagcggggcgggaccgcccggggtgccatgacccggcacgtgaccgacccggagaccgcccgccgccaattgcgggaccacgagcacgagctccaggagcacggggggagctatgaccccactgcccacgacacccggcccatgcgggtggctttggcgggcaaccccaactgcggcaagaccaccctcttcaacgccttgaccggctcgaaccagtatgtgggcaactggcccggagtgacggtggagaagaaggagggcaccgcccgtctgggcgacaagaccctgaccatcgtggacctgccgggcatctactccctgtctccctactccatggaggagatcgtcgcccgggatttcatcatcggggaggcccctgactgcatcatcgacatcgtggatgccaccaacctggagcgcaacctgtaccttaccgtccagctgctggagctggagcggcccacggtgctggccctgaactttatggacgaggtggccaaacggggggaccagattgatgtggagcggctgtccaaggagctgggcatcccagtggtccccatcaccgcccgcaccggggaggggctggaggaactgctccacaccgcccaccggcagatgcacctgggctgcaccgtagagcccgacgacctgtatgacgcctttacccacgacatccaccaccggatgggggagctgctccacgactacgcctatgccgccggcctgcccgcccactgggcctccatcaagctgctggagggggacgagctggtggagcgggcactggccctgcctgagccggtgcaggagcagctggaccgggtggtggcggaatacgaaagcgccagtgacctgggtgaccgggagaccctggtggcggacagccgctaccagtacatcgagcgggtggtagccgcctcggtgaccaaggggcagaagccgggggagctgaccctcagcgagaaggtggacaaggtggtgacggggaaatatctggccctgcccctgttcctgtgcgccatgctggtgatgttcgtcatcaccttcggccccttcggctcctggctgtccaatctggtggcggcgggcatcgacacatgctccgccgcgctggaggagactctgctgggggcgggggtgtcccaggtactggtgagcctgatctgtgagggcatcattgccggcgtggggggcgtgctctccttcctgccccagatcgctctgctgttcttcttcctgtcctttctggaggacatcggctatatgtcccgggcggccttcatcatggaccgcctgctgcggcgcttcggcctgagcgggaaggcgttcattcccatgctcatgggcttcggctgctcggtgcccgccatcatgggtgcccggaccatggagaacgagaaggaccggcggatgaccatcctgctggtgccctttatgagctgctccgccaagctgccggtgtacgggctgctctcctcggctttctttggaccctgggccgggctggtggtcttcggcctgtatgtcatcggcatggcggcgggcatcctgtccggcctgctgttcaagcataccctcttcgccggggagcccgccccctttgtgctggagctgcccccttaccgcctgccctccctgcacaacatgctcacccatgtgtggcagaaggtgaagggcttcctcatcaaggcgggcaccctgatcctgctgatgagcatcctgctctggctgctccagtcctttgacttctccctgcatatggtggagaacgaggcggacagcatgctgggtgccctgggcagcgtcatcgcccccattttcaagcccctgggcttcggcttctggcaggcggcggtggctctgctcaccggcctgatcgccaaggagatggtggtcagctccctgtccatgttctacgctttcccgctcactgccaccggcgcccaggtggcggcggccatgacggggttcacccccctgtctgccttctctatgctggtgttcatcctgctgtacgtcccctgcgtggcggcggtgtctacgctggccaaggagatgaacagcacgaagtggaccctgttttccatcgggtggcagctgggggtggcctatgtggcctctctgctggtctaccaggtggggagcctgttcctataa

SEQ ID NO: 2406 - DNA, 1659 bp, Unknown
  Artificiall/Consensus sequence
atggctgaaaaactgaagatcatttctctcggcggtctcaacgagatcggcaaaaacctcaccgtctatgaatacggcggtgacatcgtggtggtagactgcggcatgggtttccccgatgacgacatgtacggcatcgacgtggtcatccccgacgtcagctacctgatcaaaaaccagaacaaggtccgggggattttcatcacccacggacacgaggaccatatcggcgcgctgccctatgtcctccgctccctgaacgcccccatctatgccacccggatgagcgccggcctgatccgcctgaagctggaggagcaccggctgctggacaagaccaagatcatcacctgcgaggcgggcgacgtgatcaaggccggcaaattcaccgtggaattcatccatgtgaaccactccatcgccgacgcggtggcctttgccatcaagtgcccggtgggaacctgcgtccacactggtgacttcaagattgacgccacccccatccagggcggcatgatcgacctggcccggctgggccagctgggcaacgagggggtgatggccctgctggccgactccaccaacgtggagcgtcccggctatacccgcagtgagcgcagcgtgggcaattcctttgacgcacttttcaagggctgtgaggagcgcatcatcgtcactaccttcgcaagcaatgtggaccggctccagcagatcatcgatgtggccgcccgctatggccgccgggtagcggtcactggccgcagcatggagaacgccatgaaggtgtccaccgagctgggctatatgaacatcccagatggagtgctgatggacctgaaccagattaagtccctgcccaagaacagggtgtgcatcatcaccaccggcagtcaaggggagaccatgtccgccctgtcccgcatggccttctccacccaccggcaggtggatatcctccccggggatcggatcatcatctctgcctccgccatcccgggcaacgagcactctattggcaacgtcatcaacgagctctaccgcaagggggcggaggtgctcaacgagcgggagctggccctccacgtgtcgggccacgcctgccaggaggagttgaagatcatccacgccctggtcaagcccaagttcttcatcccggtccacggagagcagcgcatgctccagacccacgcaaagctggcccgggagatggggatggactccaatcatatcctcatcagcgacatcggccgggtcatggaactgacccagaacagcgcccgtctggcgggcactgtcactgcgggccaggtctttgtggacggcttgggagtgggcgacgtgggcagcgtagtgctgcgggaccgccgccatctggcccaggacggcatgatcgtggtggtcatgtccatgtccggggaggacggcagcctggtctccggccccgacttgatcacccgaggcttcgtctatgtgaaggagtccgaggggctgatggaggagctgcgccaagtggccctggaggccatcaacagcgtggacgcccgctattccaccgactggtccgccatcaagggtgcggtcaagggggacctgtccaactacctctataagaagaccaagcgctcccccatgatcctgcctgttattatggaggtctga

SEQ ID NO: 2407 - DNA, 2160 bp, Unknown
  Artificiall/Consensus sequence
atgccgggacccaatcgcgccccccgggggggctatcagaagcccaaggatctgggcaagaccatatccaggctgctgggttatctcacccgcagcaagctgcccctgatggccgtgttcggatgcctgctgatctcggtgttcaccaacatcggcggctcctacatgatgcggggcatcatcaacgacttcatctggtcgggctgcaccgacttcgccggcctgggccgggctatcctggtcctggtaggcatctacctcatcggctgcgcggccacctacggacagtccgccgtcatggtgcggctggcccagcgggggatcaaccggctgcgcaaggacctgttcgacaaattgcaggacctgccgctttcctactttgacaagcacccccacggcgagttgatgagccgcttcaccaacgacgcggacaacgtgcagctggccctggagcagagcgtggtctccatgtgctccagctgcctgatgttcgtgggcctggtggccatgatgcttttcatcaactggaagctgttcctggtcaccgccctggtgctggcgctcaccatggtgctgttcaacaagctgggcgggcgcagccgccgcttctatcagaagcagcaggcagccctgggcgacgtgaacggcgacatccaggagatcatcgaggggctgaaggtggtcaaggccttcacccacgaggagcaggccaaggatcagttccgcaagctcaatgagacctaccgggacgcggcacagaaggccaacttctactccaccatgattatgcccgtgtcgggcaacctgatgaacatcagctacgccctcaccgccgcattcggcggactgctgtctgtcatccagggctttgacctgggcggcctggtggtctatctcaactactccaagcaggtgggccagcccctgaaccagatctcccagcagatgaccaccctcctctccgccctggcgggcgccgagcggatctttgaggtgatggacacccagcccgaggtggacgaggggaccgtcaccctggtgggggcggagaaggacgccaacggcaccctgtctgtctttgacggcgcaggccggccccgtgtctgggcctggaagactccaaggaccgcggccatggcgctggtccccgtgctggtgggagcaaaggatgccctcaccgagctgggccaggcggagcggaccgagagcggcggcctgaagctgctgcctcccagcgtggactcctcccagggcatctgggtggaggtggcttctgacggcaggctcaccgaagtgaccgccctggccgccctggccggccacggctgggcctggaagtaccaggaccacacgggcaagccctccctccacctgatccggggcaccgtgcgcaacgtgcccggggaggactactacctcaccgagctgaagggggccgtccggttcagccatgtggacttctcctatgtgcccggcaaacgcatcctgaaagatgtgaccgtctacgccaacccgggccagaagatcgccttcgtaggctccaccggcgcgggcaagaccaccatcaccaacctgatcaaccgcttctatgagattgagggaggactcatcacctatgacggcatcgatgtgaaggccatccgcaaggacgacctgcgccgctccctgggggcggtgctccaggacacccacctgttcaccggcaccatcatggacaacatccgctacggacggctggatgccactgacgaggagtgcgtcgccgccgctaagagcgccaatgcccactccttcatccgccgcctgccggacggctaccagaccatggtcaccggggacggggcgaacctgtcccagggccagcgccagctgctggccattgcccgggcggccgtggccgatcccccggtgatgatcctggacgaggccacctcctccatcgacacccgcaccgaacggcacatcgagcaggggatggatgccctgatggagggccgcaccgtctttgtcatcgcccaccgcctgtccacggtccgcaactccaactgcatcgtggtcatcgagcatggcgagatccaggagaagggcgatcaccaggagctgctggaccagaagggacgctactatcaactctacaccggtcagttccagctgtcctga

SEQ ID NO: 2408 - DNA, 2106 bp, Unknown
  Artificiall/Consensus sequence
atggagaaaaaacaatttcaccgtcgggggctggggatgctcctcctgctggccgtcattctgttcgggctgggctcctccctctatgacgcccagatgatccacggggcggagtatctggcccgctcccagaacagcattgcggagacccagaccgtggaggccgcccggggggacatcctggaccggtacggccgggtgctggtctccaaccgggtcacctatcaggtcgccctgaacaccgacgccatggagaaaaaccgcaacgacatcctcctggccctgatccgcattgcccgggatgccggcgtggagtgggaggacaccctccccattaccgcccagccccccttccgctacaccacggacacccccttccagtatcccaccaccgatgaagagggcagccccaccaccagcctcacccgcctggggcggctggccgtaaagatgaagtggatcgatgaccccaccgccgacggggcccagggcgccccccttcccaccgccgaggaactgctggaaaaaatgcgggagagctttcagctggagttggagggcgcggatatgcgcgccgtggccggagtactgtacgagctgtactaccgctccatggtgaacagctggcctccctatgtctttgcggagggcgtagacatcgacttcatctctaaggtgaaggagcagggcctctccggcgtggagatcgaggccgccaccgtccgcacctacaacaccgaatacgctgcccatctgctgggccgggtgggggccattgagaactgggatgcatataaggacctggatctggacggggacggcacgccggactatgagatggacgacactgtcggcaaggagggggccgagctggctttcgagtcctacctgcggggcaccgccggggtccgggaggtggagcggaacaccagcggcaaggtggtgtccgagaagtggaccaccgccccccagccgggggacaacgtggtgctcaccatcgacatcgaccttcagaagcaggtggaggacatcctctcccaggctatcccccagctggccagtgaggacacagagggcgccgcctgcgtggtgatggacgtgaaccgggcagaggtgctggcctccgcctcctacccctcctatcacctggccacctactctgccgatttggcggagaacagcgccgatcccctcaagcccttcctgaaccgtgctttccagggtgtctatgcccccggctccacctttaagatggtcaccgctgtcgccggactggagagcgggatcattgagccggataccgagatcatggacactggcgtctacacgtattatcaggacgacggcccccagtgctggtattggcgccagtaccggcgcaagcacggcctggtgaatgtgtccgaggcgttggaggtctcctgcaacgtattcttcttcgatgtgggccgccgggtgggcattcaggggctccaggagtttgccgccaaattcggcctcggggagcccaccggcatcgagctgtatgaggagaccggcgtcatggccggaccggagtacacccagtccatggggcagacctggtacgagggcagcaccctgtcggtggccatcggccaggagagcagccagttcacccccctccagctggccaactacatcgccaccctggtcaacgggggcacccggtactctgcccatctcctcaaggaggtcaaatccagcgacttctcccaggtgctttacacctatgaaccggaggtgctggactccatcgacatccagccggagaatctggatgcggtgaaagcggggatgctggccctgaccaccgggaagggctctctggcccgctatttccaggaccttcctgtccaggtgggcgccaagaccggctccgcccaggtcaacgccgagacggaatccaacgctgttttcgtctgcttcgccccctatgacgatccgcagatcgccatctccctggtggtggagaagggcggcagcggctccactctggccagcatcgcggcggacatcctgcgctactacttctccgccgaggagtcgcgggaagagaccttgacggagaacacccttatccggtaa

SEQ ID NO: 2409 - DNA, 2574 bp, Unknown
  Artificiall/Consensus sequence
atgctccaggcggcggagggggagatgaccggagatgactggtccgcccttggtgtcttctggatcagccggcccgatgggaaagagaggggactggcctgcttccgccgctccgccggcatgggaagcggctgggggacctgcaacctgggcatctgtatggaacaggggctcggagtggaggccgacccccgccaggctttctggctttatcagcaggccgtggagatggggagcctgtcggcggtgtgcaatctgggcgtctgctatgagcaggggattggaaccacttcagaccagaaaaaggcggtggagctgttccggcgagcggcggagcacggctcctcccgggggcagaggctgctggcccgctgtctggaacaggggctgggactgccccaggaccaaaaggctgccctggaatggctgcggacctccgcccttcagggggacgcctccagccaggcggagctggcccggcactatgagtttggcgtcgggacggagatctcccccaagcaggccgtacagtggtaccgccgtgcggctcaggcaggtgatgcggacggacagtgctgtctgggctggctgatggaacacggaaaatgggtggagcaggacgcggacggcgcggtccagctctattcgcaggcggcggagcaggggcacagccgggccgctctgcttctggggatctgctgcctcaatgggaccgggatgccccgggacccagaccgggcctgggacctgctggtccgggcatgggagctgggggccgagtccgcggcctgcgagctgggacagatgtgcctgaagggggatggggtccctcagaatgaccaggaggcggtccgctggtggaccctgggggctcagaagggggactccacggcccagtatgatctgggatggtgctgtgagaagggccgggggatcggacaggactatgctcaggccgcctactggtaccgccgctctgcggacggaggggacagcgatgctatgtgcaacctgggctggctctatgaggcgggtcagggcgtggagcagagctgggagaaggcggcggagtggtatctgcggagcgccgaggccgggagcggccgggccatgggcaacctggcttggtgctatgacaacggaaaaggcgtggagcaggaccacgccgaagccgcccggtggttccagcgtggagccgagtctggagacgtacgttccatgtactgcctggcctgggactatgagcatggggagggcgtagaggccagcctccctcttgccgcgcactggtatgaacaggcatctgaggccggagacgcggaagccagccgctgcctggggtggctgtatgagacagggcagggcgtggatcaggacgggaaaaaggccgcagctttgtaccgccgtgcaatggaggcgggcagcatccgcgccatgggaaatctggcctggtgctattctgaagggatcggggtagagcaggaccaggtccaggcaacagagctgtatcgcagaggcgcggaagcgggcaatccccgctctatgagcagctttggataccggctcctccacggcaggggcattgggaaggatgacaagcaggcagtcatctggctgcgaagggctgcggaacaagagcaggacaacgccatgtgcaacctggggtggtgctatgagcgtggacacggtgttccccaggactggaagcaggccgtggagtggtatcggcgggcggcacaggccggaaatactgttgcgatgggaaatctgggctggtgctatgaaaagggaaaaggtgtggaaaaagacccggcagctgcggtaagctggtacaggcagggagcagagcggggttccgtccgatccatgtatgaactgggccggtgctgtcagggcggcattggagttgcagaggacctgaagcaggcgttgatctggtttcacaagtccgccgaagtgggggatgccgactccttggggcttttgggctggtcttatgaatacggcatcgggacagaacaggattacgccagggcagtcgaatattaccggtgtgcggcagagaaggggaatgcctccagcatgaacaatctggcggagatgctggcaaatggaaggggagggccccgaaatttcgaacaggctatgttttggtatcagcgtgcagcggaggcagggagtgtctgtgcgctctataacatgggctggcatgcagaacaggcgggccgcatcgcagaggcgctggactgctaccgacaggcccagcagtccggggatgaagctgccttttgggcactggggcgtttttatgagatcggaattggagtagagcaggacccgaagcaggcgtttgcgctctaccaggcgggtgcggaaaagggaaacgtcaactgccgctgccgcctgattcgatgttatgctctggggatcggaacgccgcgtgatccggacacggcccggcagctggggcgtgcgctgctctgtgagaagctggacccctgggacttagaggactatggctgtcagccggagctggagcagcttctgcagcttatggatacattagagacctaa

SEQ ID NO: 2410 - DNA, 2070 bp, Unknown
  Artificiall/Consensus sequence
atgggcccggcgggggagaacagatggagccgttggcggcggctgctggtcccgtccctgttttttgctggggtcatctactatgaagaactgtttttgaagctgttttgtttccacgccgtcacgccggtgggggcgctgttcaccctgttgttcaccctgcccatcgcgatcctgctgggactgctgtgcggcggggtcgccccacgaaaggggcgggtgctgctgctggcaatgaccctgctgctctccgtgtggatgggagcccagagcatctattatcacctgttcaagaccttcctcacagctttctccctgactaagatggggatggtggccggtgctttcggagacatggcggttggggagatcctgctcaactggttccccatcgccatgatggcggtccccttcggactggcggtggtcctccgccggcgtctgatcccggaggagggccccatgtccagaaggatgggggcacggtgggccctcctggcggcggtggtccagctggctgccatgggcatcgtgatgtgctgcggcgggggctccatgtccctgcgcttcatctatctccaggcggcggtgccggaactggaggtgcagaactttgggatgctgacccagaaccagctggagctgcgcagagtgctcttcgggattaccccggaggaccagagcctccggaaggggcaggcgctccacctctaccggccggccagtgagccggtagaggtggagtccgcggagtattcctccgcggactatcacatcttggacatcgatttcgaccggctgatagcggaggagacagacgaggacctgctccagatgcacacctatttttcccagcaggtgcccacagcaaaaaatgagtggacgggctattttcagggaaagaatttgatctggatcgtggcagaggggttctgtaccctggctatggacccggagcgcactcctgtgctctatgagatggcccactctggctttgtgtttgaccacttctacaccccgctgtggggggtgtccacctcggatggggagtacaccaccaccacggggctcatcccaaagtccggggtgtggagctactcccagtccgcaggaaattacatgcccttcggttttggaaaccagttcagccagctgggctaccggacgatggccttccacgactacctctatacctactatgaccgggataagtccttccccaacatgggctatgagtactatgccctggggcacgggttagaactggaagagatctggcctccctctgacctggagatgatggaagagatcgttcccatgttcgtggacgaggagcagtttatggtctactgcctgacggtgagcggccatctgaactacacctatgaggagaacgccatgtcccgcaggcactgggacgaggtggctggcctgccgtacagcgaggggcccaaggcatatctggcctgtcagatggagctggaactggccatggagagcctgctcacccagctggaggaggcgggcaggctggatgacaccgtcatcgtcctttcaggcgaccactacccctacggactgaccgacgaggagtacagtgagctgctgggccgtcaagtggaccccaactttgagatattccagaacaccctgattctgtggaacgcccagatggaggagccggtgcgggtggagaagctttgctccagcctggatgtaatgcccaccctggctaacctgttcggcctggagtatgactcgcggctgatggcggggcgggatatcctgtctgacgaacccgggttggtgatcttctcgaattacagcttcctgacagaggagggggcatacaactcagtgctggatgagttccggtcctgggacggctccccgccggacgaggcgtatgtgcagagccagatcgccgaagtgcagaaccgggtggcctattcggccatgatcctggaccacgactactaccgggtggccctgaacgggccgcccagggaggaaggctccctgttcagtgcccatcgggagccccagccggactccggctggctggactga

SEQ ID NO: 2411 - DNA, 2172 bp, Unknown
  Artificiall/Consensus sequence
atgacaagacgcgcgctggcgctggtgctgaccctggctatggcgctgtccctgtgtctggcggcccaggccgccggcccccaggtgacggtgaccctggatgggacggcgctggagctggaggtccccgcctatatcgacgggcaggaccggacccaggtccccgccagcatcggcccccagctggggctgacggtccagactggtgacgggagcgtcaccttcaccaaaggagaggccagcctgaccttccaggacggggccaaggaggcgggcggcgtgaccatggacaccgccgccgacctgtccggcgaggtgggctatgtgcccctgacctatctggcccagttcttcggcttccaggtggcctggaacggcgtcacccgcactgcggcggtcactagcacggccgcggaggaggagaccgctgtgaccaagctgccccagctggtgtattcagagctggagagcctgatggcccagcaggcagcccagtatcagaccaaggacaacgtggtgcccatgctgtggcagggcgtgctggaaatggacatccaggtgggcgatgccgcccgcaccgccaagctctacgtgccccagggcacgccccagggcgccatgttcgtggtgatgaacgtccctgagggcctgaacgccgtgagcttcatggagaccagcggctggatggacaaggcggacgaggagggtttttgcctgttcgtgctggaacccgcccagggtactccctggggaactctggaggaggagcaggcatacatcaatgccggcatcagcgccgccaaggcgggcaagtggctccagcccggtcccagcatgtacctggtgggctacggtgccatgggtacctgcctgcagaagtacgccatggagaatcccctgaatatcgccggagcggtgttcctggatgccagcctcattgacgccggctacatggcgtccaacggggatgtgtcctttgataccgataccaagacctacggcgtcacccgcaaggaggtgccggtgcccgtcaagatcgtggaaagcaccatgacggagcaggcaaaggctgtggcggactactggcaggccgcagccaacgacaagaacgccgtggagcgctttgctcctgaaggcggcgagatcctggcggccgccgtggtcaccgaagaggggaactatgactatgccctgcctgccaccaccgacatgatctgggacttcatgggccagttctaccgctacggcggcggtgtgctgtccaacgctatctcctggaaggtggactatgaggagatgggagtggagttccgaagcttcaccgactcccagggcatcgaccggcagtatctggtctatatccctgaggcttaccgcggcagcggcgagcagctgcccgtggtcatcgcctatcacggagcctccacctctatgcgcaatttctttgagaataccttgtggtacaatatcgccgatgaggagggcatcatgctggtgttccccgagtccaccctggtgccggtgccccccaccctgggcggcggcgaggccaaccccaccgcctaccgcgcgctgtggcaggtggaggaccctgagctgcgctacaccgacgtggtgtatgccgaggacctgctggaccagctgatcgcagtctatccccaggtggatcagggccgcatctactgcaccggccactccatgggctgcatgatgacccactacctgggcagtgccgaggtctcccaccgcttcgccgccatgggcgccacctctggccccctgatggccagggaggagacgggatcccagaccgtgcccatgttcatgaccatggcccagtacgacatgtggagctatgacctgaaccaggacgacaccatgaccacccaggcggtggacatgtggctggtccgcaacgggctggcggacgcctccaacgtggtcgaggtccgtaagaccggggccactgagacctatgtggagggccgctacaacaactccgtctgggagaatgaggacggcatccctctgttccgctacgcctgggtcaccggcaaggaccatgtgaacctgccggcagagaaccagctgctgtgggacgagtggttcagccagatcaccctggacactaagacaggcgtgcgcgcctatcagggacaggccatcggctga

SEQ ID NO: 2412 - DNA, 1917 bp, Unknown
  Artificiall/Consensus sequence
atggagaacctgacgaataccgcggtccacctgctggaggacagccagggggccgacctgacccggcgggagaagcgaaagctctcggtggagatcaccaccgccatgatagccctggtctgtctggtcaccggactgctctataaggggatcttcccggagcagacggcggtggcggggctgatctattctgtgggcgtgctggtggagggcctgcccctgctggcgaccgccatccggggctttctccagcgggacgtgaccaacgccatggagatcctggtctccatcgccgtgctggcctgctacatcactgggcagcacgagctggccatcctgatcccagtggtgctcagcgtggtccactttctggaggagcggagcatcatgggaggccgggacgccatcgagggccttaagcagatgcaggccaccgacgcggtgctggaaactgaggatggggaggtgacggtggaggtccaggcattgaaacggggggacatcatcattgtccgacctggcatgggcctgcccatcgatggcaccgtaatctggggcaattccaacatcgaccagaaatccctcaccggtgaacccctgcccgccgccgtgaccgtaggggacacggtgtacgccggcaccaccaacctggacggcatgatcaaggtccgggtggagaaggaatatcaggacacctccttcaccaagatcgtcagcctgctggaggaggcccagagcatcaccgtgcctgagatccggatcgtggaccggttcatgcactactacatcccgctggccctcatcgtggccgccctcaccgctctgctcagccgaaatatctccaacgccatcgccgtgctggtggtgagctgtccctgcgggcacatgctggtcagctccgcccccatgatcgctgccctggcggtgtccaccaagcggggcatcctcatcaaaaacgccaaattcgtggagcagctcaccaacatcaccactgtgatctttgacaagacgggcaccatcacccggggggagctttccatcagcggcttctatcttcaggaggcccagagcagggaggagctcttcgccagaggcggctgcgtggcgtgcagctctatgcaccccatctcccgctccctaatgaagaccttagagggggagggcatcccctatgaggaggggttccaggtccgggagaccgcgggcaaaggactgaccgggacccggggcggggaagagatcctgttcggctcacggcactggatcgagtccctgggctaccagccggaggacccccatatggacaccggagggggtcccgccaactgggtggtgtacaatgggcgggtgctgggctgcctcatgtttgatgactccgtccgtccggaggctgaggaggtggtgagccggctccacgaggacgggatggaacagactgtgctcctcaccggcgaccgggagttcgctgcccggaaggtccagcggcagacagggatcgaccaggtatatttccacctgctgccggaggagaagctggagcacgtgaagcggctgaggcaggacgcccatgtgcttgcagtgggagacggcatcaacgatgccctggccctggcagaggcggacgtgggcattgccatgggggccatgggctctgatgtggccatccagagtgccgacatcgcccttatgaacaacgacctgaacaacatcccctttgtcatgtccctggccaggagcaccaagagcatcatgtatcagaacatcggcatcgccttctccgtcagcctcattatgatgatcctggccgccgtgggggtgatccccgccctggccggggccttcctccacaatatcggagcctttgtgatcctgatcaacagctcccgcatcctccgggacagcggcggggagggctga

SEQ ID NO: 2413 - DNA, 2109 bp, Unknown
  Artificiall/Consensus sequence
atgagtactgcgatcaccgagctgtttggcacaaatgtgttcagcgtctccgtcatgcgggagcgcctgcccaaaaaggtgtttgccgaagtgaccaatgtgatggagaatggcggcagcatcagcatgagcaccgccgatgtggtggccaacgccatgaagaattgggcgctggagaaaggggctacccactatactcattggttccagccccttaccggcatcactgcggagaagcacgactccttcctcaccgccccggtggagggcaagaccctgctccagctgtcgggcaagcagctgatccagggggagccggacgcctcctccttcccctccgggggcctgcggtccacccactacgcccggggctacaccgcctgggacatgacatcccccgcctttgtgaaggagatgtcctgcggcaccatcctgtgcatccccaccatctttgtctcctacaccggcgaggcactggacaaaaagactcccctgctgcgctccatggaggccatcaacacccaggccctgcgcatcctgcggctgttcggaaacaccgaggcccacaaggtgaccccctccgtagggccggagcaggagtatttcctggtggaccgggagaagtacctgaagcgtcgggacctgatctacaccgggcggaccctgttcggtgcccctgcccccaaagggcaggagctggatgaccagtacttcggcgtcatacgggagcgggtgggcgcctttatgaaggacctgaacgtggagctgtggaagctgggcatcccggccaccacccagcacaacgaggtggcccccgcccagcatgagatggcccccatctattctatgtgcaacttagcggtggatcagaaccagctggccatggagaccatgaagcgggtggcgacccgccacggtctggtctgtctgctccatgagaagccctacgccggcgtcaacggctcgggtaagcacaacaactggtccatcggcacagataccggggagaacctgctggaccccggggacacccccaatgagaacatgcagttcctgctggtgctctcctgcatcatgagagcggtggaccgccatgccgacctgctgcgccagtccgcctcctgcgtaggcaatgagcaccgtctgggtgcccaggaggcccctcccgctatcatctccatctttttgggggatcagctggacgatgtggtgagccagattgtctccaacgcggactccatcaagctgctcacctccagcggactggataccggtgtgtccacggttcccgtcatcaagaaggatgccaccgaccgcaaccgcacctccccctttgccttcacgggcaacaagttcgagttccgcatggtgggctcctccgactccatcgccgacgccaacaccaccctgaacgccatcgtggcggagtccttctgtgaggcggcagacgagctggaaaaggcggcggactttgactccgcctgcaccaagcttattcacgatatgatgacggagcatcagcgcatcgtattcaacggcaacggctactccgacgagtgggtagaggaggcggaacgccggggcctgcccaacctgcgctccatggtggacgcggtgcccgctctgctcacccccaaggcggaggctctgttcaccaagttcggcatctacaccaaggcggagctggaggcccgggcagagatcatgtatgagacctatgccaaggtgctgaagatcgaagccaagaccatgacccacatggcaggcaagcactatgtccccgcagccatcacctataccacccggctggccgaatccatcaccgccgtcaccgccgcctgtccccaggccgacctgacggtgcagcgggagctgctggagaaggtgagcctgcgcctcaccgccgccaccaaggccctgaacagcctgaccgagctggtggagcaggtggacgccatggaggatgtgaaggagatggccctggcctaccacgaccagatcgtcccagccatggccgcgctgcgcaagccggtggatgagatggaactgctggtggataagtccatctggccggtgcccacctacggcgacctgatgttcgaggtgtaa

SEQ ID NO: 2414 - DNA, 2016 bp, Unknown
  Artificiall/Consensus sequence
atggatcaatacataggtaaattactcgataatcgatatgagatcctggagatcatcggcaccgggggcatggcccgggtgtacaaggcacgctgtcaccggctcaaccggctggtggccatcaagatccttcgggaagatctggcccaggacgcggagttccgccgccgcttccacgacgagtcccaggccgtagccatgctttcccacccaaacatcgtggccgtttatgacgtcagccgctcctccgacctggaatacatcgtgatggaactgatcgacggtatcaccctgaagcagtatatgcagaaaaaggggaacaagctgaactggcgggaggcactccactttatcacccagatcgtcaaggcattggggcacgcccacagccggggcatcatccaccgggacatcaagccccacaacatcatggtgctgcgggacggcagcgtgaaggtggccgacttcgggatcgcacgggtggcttcaggcgggcacagcaccctgactcaggaggcgctgggctccgtccattatatctcccccgagcaggccagagggagccatattgacgcccgctccgacctgtactctgcgggggtggtgctctatgagatgataactggccgcctgccctttgagggggacactccggtctccgtggccatccagcacatcaattccatcccactctccccccgtgagctggaccctaccatcccagaggcgctggaggccatcaccatgaaggccatggctcccaacccagacaaccgatatccctccgcagacgcgatgctggccgacttggaagagttccgtaagaaccccagcatcaactttgactacgacgtgagcgagttcgtgcccgaggagccggaagagggcgccatgactcagatccgcacgccccatacgccggtgcgcagccgtgtgccggagcctgaaccccgcaggcgccgctacgaggagccggaggaggaagaggaggagctggagaaccgtcccaggcgccgggaccgccggcggggagggacaaactggcccatcatcgcggccatcgttgtcatcctggcctttgtggcgggactgttctacttcatgtatcagttcttcatctcctccatcctgatgccctcgccggactataccatccccaagctgacgggctacacctatgaggaggtccttcaggacccggagctgagacaggagttcaacatcgtcgttggccagacggtggaaagcgaggaggctgcggggacgatcctcaggcaggaccctgctgccgggagcaccgtgaagtccaacaacgcagagatcacggtgacggtgagcggtggacccgaggtgatccagatgatcgatgtcaccaaccaggaatatctgaaggccctggccaccctgcgggacatggggctgagcgtggaggcccccgaatatcagttcgatgatgaggtgcccgccaactatatcatctcctatacccctgcggaggggaccgaactcaaggcgggggacagcgtccatctggtggtcagtaaggggcctgaggcgtccaaggtcacgctgatctctttcgcggacatggcccagagcgacgcggagagccggatccgtctgatgaacctggaggtgggtgagatagagcatgtctccagtgaaacagtaccggagggaaaggtagtggaacagtggccggaggctggtacagaggtggaagaggggagcaaggtcaaccttaccgtcagtacagggcctgagaacccggacattcctcagacatcaaccaagacactcaccatcaacctgccggtggtggatgagacggaccctgtccagtccatcaatgtgatggtcaccagcgacgacggaaaggaagtttataaccgggatgtgaaccctcttatggaagtggctgtgtcagtaccggtcagtgggacagggaaagtgacatacaacgtctatttcaatgggagattggaccacggcgtcacggtcaactttgacgagtga

SEQ ID NO: 2415 - DNA, 2565 bp, Unknown
  Artificiall/Consensus sequence
atgagcaaaaaaccccaatatgatcctgaggggatccgtttcccggaccagaagatcgagatatcccctctggtgcccgagatggagagttcctatattgaatatgccatgtccgtcatcgtgggccgggccctgcccgacgtgcgggacggactgaagccggtccaccgccgcatcctctacgccatgtatgagagcggcctcaccgcggacaagcccttcaagaagtcggccacctgcgtgggcgacgtgctgggacgctaccatccccacggggatcagagcgtctacgacgccttggtccgcctggcccaggacttctccatgcgctacatgctggtggacggccacggcaacttcggttccatcgacggcgatccccccgcggcctaccgttacaccgaggcccgcatgtccaagctggccgacgagatgctgcgggacattgagaaggacaccgtggattgggaccccaactttgacgagacccggaaggagcccaaggtgcttccctcccggttcccaaacctgctggtcaacggctccagcggcatcgccgtgggcatggccaccaacatcccgccccacaatctgcgggaggtcatcaatgccgtcatctgcgtgctggatgatccggaggcccagctctccgacctgatggagcacatcaagggccccgattttcccacccggggcatcatcatgggccgcagcggcatccgctctgcctacgccaccggccggggccggctgatggtccgggcccgccacgaattcgaggagttcggcaaggaccgggtgcgcatcgtcatcactgagatcccataccaggtgaacaagcggatgctcatcaagaacatggccgaccaggtggaggacaagcgcctggagggcatctccgacatccgggacgagtccgaccgcaacggcatgcgcatcgtcatcgagctcaaacgggacgccaatccccaggtggtgctcaaccggctgttcgcccagacccagctccagaccacctttgccatcaacatgctggctctggtggaggtcaacgggaagcttcagccccgcatcctctccctgcgccacattctggacgagtacatcgcctatcaggagcaggtcctcatccgccgcacccgctttgacctgaagaaggcccaggagcgggctcacctgctggaagggctgctcatcgcggaggacaacatcgacgcggtcatcaagaccatccgtgagagctacgacgacgccagggagaatctgatggcccgcttcggcttggacgaggtgcaggcccaggccatcctggacatgcagctcaagcggctccagggcctggagaaagagaagctggaggcggagtacgctgaactggagaagcgcatcgcctactataaccagcttctggctgatgagtccatgctccggggcgtgctgaaggacgagctctccgccatccgggacaagtatggggacgagcgcttcaccgagatccaggatgtggaggacgagatcgacatcgaggatctgatcgaggaggagcagtgcgtcttcaccctgacccaggcgggctacatcaagcgcaccccggtcagtgagtatgccgcccagtccaaggggggcatgggcaagaaggggatcaccacccgggaggaggactacgtggtggacgtgttcaccgcctccacccacgactatatcctcttctttaccgacacgggcaaggtctaccggaagaagggctatcagatcccggaatctggcaagacggccaagggcaccaatatcatcaatatcctccaggtggagtcgggagagcgggtccagaccatgatccacacccggtccatcgaggacgacggccgcttcctcttcatggtcacccgaagcggcaccgtgaagcgcctgcccgccaacaccctgaaaaacctgcggaacaacggaatccgcgccctgcgcatggatgagggggaccagctgatcgccgtgcgggagaccgatggacagcagcgcatcctcatcgccacccacgacggcatggcggtgtgctttgacgagaacgacgtgcggcccatgggccgggaggccgtgggcgtccggggcatccgcctgcgggagggcgactacgtggtgggcgccgcccgggccaaggcggaccatgaggtgctgtccatcaccgagaagggctatgggaagcgcacccccgtggaggagtaccgggtcaccaaccgtggcggcatcggcatcaagaactatatggtcactgagaagacagggagcgtggtgggcatcaaggtggtggacggcagcgaggacctgctgctggtcacccagagcggcatcctgatccgcacccctgtggacaacatccgcaccgccggccgggctacccagggcgtcatcgtcatgcgcttcaaggaggagggggaccaggtcatctcccttgccctcaccgaccgggaggagaccgccggcacccaggagacggaggagggagaccccgccggggagagggcggaggaggcccccatttcggaagaaaaccagtccgaagaggaataa

SEQ ID NO: 2416 - DNA, 1917 bp, Unknown
  Artificiall/Consensus sequence
atggcaaagaaacagttcaaggcggagtccaagcggctgatggatctgatgatcaactccatctacacccacaaggagatctttctgcgggagatcatctccaacgccagcgacgcagaggacaagctggcctaccgtgccctcaccgatgacagcgtagaggtcaagcgcaaggatctgaagatcaccatcgttcccgacaaggagaagcggaccctcaccgtgtccgacaacggagtgggcatgacgaaggacgagctggagtccaacctgggcaccatcgccaagagcggctccctccagttcaagcaggagctggagcgggacgacaaggcggcctccaaggtggatgtgatcggtcagttcggcgtgggcttctactccgcctttatggtggcggacgcggtcaccgtcatctcccgggcctatggcgcggaggaggcgtggatgtggcagtccgctggcacggatggctacaccgtcacccagtgcgagaaggagacgccgggcaccgatatcatcatgcacatcaagcccaacgccgacgaggagaactacgatcagtatcttgagacctataaattacaagagctgatcaaaaaatactccgactatatccgctatcccatcgtgatggaggtggaggactaccgtcagaaggagaagcccgccgacgccggagaggactacaagcccgagtgggagacagtgaaggagtggaagaccctcaactccatggtgcccctgtggcagcggcagaagagcaaagtgaagccggaggagtacaacgccttctacaaggagaaatttggggactggcaggaccccctgaccgtgatccacaccagcgccgagggcgccgtcacctacaaggccatgctctatatcccctcccacaccccctacgacttctatacccgggagtatgagaaaggacttcagctttacagctccggcgtgctcatcatggacaagtgtgccgacctgctccctgaccacttccgctttgtcaggggcgtggtggactcccaggatttctccctgaacatcagccgggaggtgctccagcacacccgccagctgaaggtcattgcctctgccctggagaagaagatcaagggggagctgatgaagctccagaaggaggaccgggagaagtacgagacattctggaagtccttcggtacccagatcaagtatggcgtggtagccgagtacggccagcacaaggagctgctccaggatctgctgctgttctggtcctctaaggaggggaaggacaccaccctggcggagtaccgggagcggatgccagaggatcagccctattactactacgcctgcggcgagagcgctgagaagatcgcaaagctgccccaggtggagcgcattttggacaaggggtacgagatcctgtactgcaccgaggacgtggatgactttgtcatgcgcggcctgggagagatcgacgggaaggcgttcaagtcggtgaatgacgaggatgccctgccccagagcgatgaggagaagaagacggccgaggagaaggcggaggcgggcaaacctgtgctggaggctgtcaaggaggccctgggcgaggaggtgaaggaggtccgtgcctcctccatcctgaagtcgggggcggtgtgcctgacggctgacggcccggtctccctggagatggagaagtatatgcggaaggtggatggggaccgcgccgcccgggcccagcgggtgctggagctcaacccggattccgctccctttgccgcgctccaaaaggcggtggaggcaggggacaaggatacggtctccaaatacgccaagctgctctacggacaggctctcctgctggcagatctgccgctggaggacccggcggagtacgcgcagctggtctgctccctgatggtgtga

SEQ ID NO: 2417 - DNA, 1896 bp, Unknown
  Artificiall/Consensus sequence
gtggttttcctgaaacggttcagcgcgcgggacctgatcttctatctgctggccatcctggtgatggtgttcaccttcaatgcggtgcagcagatgaacgagccggatgaccccacttataatgagatccgcctgctctttgagcaggagaaggtgaagtacttctccgtggaggacaatgtgctcactctgactctgcggggggagggagaggacacctccaccctgaagtaccacctggccgacttcaatgtgttctataacgacctgcacgagcttatcgacagccagcgccaggctgggatcatccaggactatgactaccccgccggctgggcggagccttggtggttcgcctatgtgccctacctggtgatcctgctgggcttcggcatcctgatgtacaccatgtatctgcggcagaacactgggggcggcggaggaggggggccgtcccgcttcggccatgcccgcacccgcaccctggcagaccaggggaagaaggtcaccttcaacgatgtggccggtgcggatgaggagaaggaggagttggaagagatcgtggagttcctccgggacccccagaagttcaccgccctgggcgcccgcatccccaagggcgtgctgctggtggggcctccgggcacgggcaagaccctcatcgccaaggcggtggccggcgaggcgggggtccacttcctgtccatctcgggctctgacttcgtggagctgtatgtgggtgtgggtgccagccgggtgcgggacctgttcgaccaggccaagaaggacgcccccgccatcgtgttcatcgacgagatcgacgcggtgggccggcagcggggcgccggcctgggcggcggccacgacgagcgggaacagaccctgaaccagctgctggtggagatggacggctttggctccaatgagggggtcatcgtcatggcggccaccaaccggccggacatcctggaccccgccctgctgcggcctggccggttcgaccgccagatctatgtgggactgcccgacatcaagggccgggaggagatcctgaaggtccacgcccggaagaagcccctggcggaggacgtatccctctccgatgtggcgaaggccacctccggcttcaccggtgcggatctggagaacctgctcaatgaggcggctctgctctctgcccgggaggaccggcgtttcattacccgccaggacctccacgaggccatgatgaaagtaattgccggcccggagaagcgcagccgggtggtgacgccccatgccaggcggcttaccgcctaccacgaggcgggccacgccgtggtgatccacgagctggacagccaggaccccgtgcaccagattaccatcgtgccccggggacaggcgggaggcatgaccatctctctgcccagggaggaccgggcctatctgtccaagcgggagctggaggagcgcattgctgtctgcctgggcggccgggtggcggagcagctggtgctcaacgacatctccaccggtgcctccagcgacatccagaaggcgtctcagactgcccgggctatggtcaccaagtacggcatgagcgagcggctggggaccatcgcctacggcaacgagaacgatgaagtgttcatcggccgcaccatggcccaggcccggacctactccgaggaggtggcaggccagatcgacgaggaggtcaaggcgatcgtggaccgggcctatgcccggtgtgaagagatcctgacccggcggcggcaggagctggagctcaccgcacgctatctgctggtccatgagaccatgagcggcgagatctttcaaaaagtgttcactgacccggcggcccctgagctggcgcttccggaggaggaccagccggcccaggagggctga

SEQ ID NO: 2418 - DNA, 2352 bp, Unknown
  Artificiall/Consensus sequence
atgaggaaatcgatcaaacatctctttggccttaccctcggtgtgtctcttgccctggggctcatctcctccgcctcggcagagggcagtgtttctgtgcaggtagacggcaagacggtacagtccgccgcatacattgatcaaaacgaccgcaccatggtctcgccggatatcgcggacgctctgggactgactcagaagcaggaaggctccagagtacagttcacccggaacggcgtcagcacctatttcaccggcagcgatgccactttttccggctctgagatggacactgtccctgctctgcgggatgggaccttgtacgtccccctcgcttatctggcccaggcttacaacatgccggtctcctgggatgcaggttccaaggcagtctctgtgtctaccacctccacaggccccatctcgctggatggcgtaccggcccccgcctttgattactccgatgccaaccagctgcccatgacgggctatttcagcaagactttgacctatcccgatctccaggggaactcggcccagcgagaggcctacatctatatctccgagcatgcctcctgtcggccctatttttacgtgatcgccctgcccgacaaggtcgatcccacccaatttctgatggaaaatggctggttcgatttggcggaagaaaacggcgaatgtctgtttgtgctggcccccggcagcggcggctgggggtccgtggaggaagagttgcctttcttgactgccgctctctcctggctgaacacgcctgtggccgacgaggccgatcccaacgcgcctgacaaaaacaaaaattactggtccgcctttggcgagtggtattttgtaggctatggtgaagggtgtgcccctctggaggcttggtcagccaaaaatcccatcttcgtcatcgctcaggtgtatctgaacggcgtcagcgccggcgaggcatatctgtccgaagtaggcagccaggtctatgcggtaggcaccaacggctatgacatcacagagaatgtgaagagccgcctggcggcccgcggcgatcagatgatcaccaatcaggacatccctgttcccacttggttcgtcaactatgatgccgcggaccacagccttcagtattggaagactgccaacgactgctccccttccggcacccagaacgccgactacggcaccgtatatgtccaggccggggactctgacgcctggcagacccagtatgcgggccccatctccaaggtggctgtggacagccgacagtccctctccggccgggagatccatgatttcctgacctgctacacccgctatgacaacacttccgcctacggaaatgccctgatgctgcggggggattataccgacgtgatcgtcaacgcccacaagtcccctgaccgctatgctgaacagaaggtcactatgcccgatggcgcgaccgccacaatgatctgcaccatcgtggacatcgagggcgagccccgcgagatcctgttctacatccctgagaacgcatccgaactccagcccgacggcgcccctgtcatcaccgtctgggctggcggcagccagaccaacatcatcttctttgactccacctgctggtgggaaactgcaaaccaaaacggcatcgcgctgatttttaccaacgaagcctacaacacctctgtcgctgtcacccccgccgatgtggatgcctgctaccacgccatgctggatctcctggagggttggaatgactccggcaaattccagtttgatctcagccggatctacagcaccggccagtccatgggctctatggaatctcagcagtttgcccaggagaccccggattactacgccgctgtagcctccacctctttctatcaggactatcccgacgcccactctgacaagcccatccccacttacctgatcaatggcgagggcaatggcaaagatgacaccggcaccccctatgacgaccgctggaaccgcacagacgactgggcacagtatttcctgcgagtcaacggctttgtgtacaccccggcggtttacgccgctgacggaacagtcaccaccttcggcgtgcctgtctccgagcctgttttcaccgtcacaggcccctatgaccgtttcgagacctatacctggatcaatggacaggacattcccctggtccagtacaccaacagcttgtaccgcccccacaactgcctgacctccgagatccccatgctgtgggacttcttggagcactaccgctgtgagcgggacgaagacggcgctgtgaccgcccgctactacagtgcctccgccttcaaacgggacgatcaggtcctgatccagtttggcgcctga

SEQ ID NO: 2419 - DNA, 2520 bp, Unknown
  Artificiall/Consensus sequence
gtgattgatttgaagtacgatttcacagccatcgaaaagaagtggcagagcaggtggaaggaggaaaagaccttcgcctgccagaacggcgacacctccaagcctaagttctacggcctggtagagttcccctacccctccgctgccggcctgcacgtgggccatcccaggccctacaccgccatggacgtgatcgcccggaagaagcggatggacggctataatgtgctgttccccatcggctacgacgccttcggcctgcctactgagaacttcgccatcaagaatcacgtccatcccgctaaggtgaccaaggacaacatcgctaactttacccgccagctccatatgctgggctactccttcgactgggaccgggtggtggacaccaccgaccccggttactacaagtggacccagtggattttccttcagttatataagcacggtctggcctataagaccaccatgcctgtgaactggtgcacctcctgtaagtgtgtgctggccaatgaggaggtggtagagggcgtgtgtgagcgctgcggcgcccccgtcatccgcaaggaaaagagccagtggatgctgaagatcacagagtacgcccagaagctcatcgacggtctggacactgtggactttatcgaccgggtcaaggcccagcagcgcaactggatcggccgctccaccggcgccgaggtggtattcaaggccactaccggcgaggacatcaaggtctttactacccggcccgacaccctgtttggtgcgacttacatggtcctctccccggagcacgccctggtgcggggctggctggagagcggcaggctgaagaacgcagatgcggtcgtctcctatcagaaggcggcggcctccaagtctgacctggagcgcaccgagctgaataaggaaaagaccggcgtggagctggacggcgtccggggtgtcaacccggtcaacggcaaggagatccccatcttcatctccgactacgtcctgtccacctacggcaccggcgccatcatggccgttcctgcccacgacgaccgcgactgggagtttgccaagaagttcggctgtgagatcatcgaggtggtgtccggcggcgaggacgtgcagaaggccgccttcaccgccaaggacgacaccggcatcatggtcaactccgacttcctcaacggcctgacggtgaaggacgccattcctgttatcaccaagtggctggaggaaaagggcatcggcgaggccaaggtgaattataagctgcgggactgggtgttctcccgccagcgctactggggcgagcccatccccatgatctggtgcgacaagtgcggctggcagcctgtgcctgaggatcagctacccctgctcctgcccgaggtggagagctacgagcccactgacgacggcgaatcccccatctccaagatgaccgactgggtaaacaccacctgcccctgctgcggcggcccggccaagcgcgagaccgacaccatgccccagtgggccggctccagctggtacttcctgcggtatatggatccccacaacgacaaggctctggcgtccaaggaggccctggagtactggggacaggtggactggtacaacggcggcatggagcataccaccctccatctgctctactcccggttctggaacaacttcctccatgacatcggggtcatcccctgtgctgaaccctatgccaagcgcaccagccacggcatgatcctgggcaagaacccccattatgtgggcaatgtggagaccgaggaggagaagcaggcactcattgaaaagtacggcaatcaggccctgcgtccctctgtcaagatgtccaagtctctgggcaacgtggtcaaccccgacgacgtgatccgggattacggcgcggacaccatgcgcctgtatatcatgttcatcggcgactttgaaaagacagcggtttggtccgacgactccgtccgtggctgcaagcgcttcctggaccgggtgtggaacctggctactgagcaggagcacaccggcgaggagtactccaaggccaacgaggccgctgtccacaaggccatcaaaaaggtgtctgaggatatcgaggccatgaagttcaataccgccattgccgccctgatgtccctggtcaacgacttctatgccaacggtgccagccggggcgacatgaaggccctgctgctgatgctctcccccttcgctccccacatgtgtgaggagctgtgggagatggccggctacggcgggcaggtatgcctccaggcatggcctgagtatgacgagagcaagaccgtggccgccactgtgcagatggcagtccaggtgggcggcaaggtccgggccaacatcgtggtccccacggacagcgacgaggcggctgtagtggcctccgccctggcggagcccaagatcgcacgcatggcggaggggatggacttagtcaagtccatcgtggtcaagggccgcctggtgaacctgatcttcaagcccaaggcgtga

SEQ ID NO: 2420 - DNA, 2235 bp, Unknown
  Artificiall/Consensus sequence
atggaccctattctggaacgatatcaggcgctggaagacaaggtgagcgcctataccccgggactggacacccagcgcctgtaccgggcgtttacctatgcggacgcggagcacaaggggcagctgcgcaaggacggcaccccctatatcacccatcccctggcggtggcagagatcgtggccgacctggggctggacgcggactcggtgatcgcggccctgctccatgataccattgaggacaccaacgccacccacgaagaagtggccaagcagttcggcgagacggtggccgccctggtggaaggggtgaccaagctgtcccgggtgcagtacacctccaaggaagaggagcagatggagaacctgcggaagatgttcatggccatggcccaggacatccgggtgatcctcatcaagatctgcgaccggctgcacaacatgcgcaccatggaataccagtcccccgccaagcagcgggagaagtctctggagaccatggagatctacgcgcccatcgcccaccgcctaggcatgcagaagctgaagtgggagctggaggacctgtccctgcgctacctggacccggtaggctataaggagatcgaggacgagctggcggccaggtcctctgcccatgaggagttcctggccgccgtccagcagcgcatcacccagcggatgtgggaagagggcatccgctgcaaggtctacggccgggtgaagcacacctattccatctaccgcaagatgttcgcccagaacaagacactggatgagatttttgacctgtatgctttccgggtcatcgtggacgacatcccggagtgctacaatgtgctgggctgcatccacgacatgttcaagccggtgctgggccgattcaaggactatatcggcacccccaagcccaacatgtaccagtccctgcacaccaccgtcattggccgggagggggtccccttcgaggtgcagatccgcacctgggccatgcaccagacggcggaatacggcgtggccgcccactggaagtataagcaggggctggccaacaagcagctgggcacggagcacgacttcgagtgggtgcgcaagctgctggagagccagcaggacaccgacccggacgagttcgtccgcaccctgaaggtggatatgtttgccgacgaggtgttcgtcttcactcccaacggggacgtaaagagcctgcccgccggcgccacccccatcgacttcgcctactcggtccactccgcggtgggcaaccggatggtgggggccaaggtcaatggccggatggtcccctatgaccaccagctctccaacggcgacatcgtggaggtgcttacctccaagacggccaaggggcccagccgggactggctgaagatcgccaagagcaacgaggcccgcaacaagatccgtcagtggttcaaaaaagagaagcgggaggagaacatcgccaccggccgggcagcttttgagtcggagctgaagcacgtgggcctgaagctggaggctatcaccgccccggaggtgctgcccagcatcctgcgcaaggtgcgcttcggcaccttggacgagctgtacgcctccatcggttacggcggcaccaccgcggtgaaagcggtggcccgcatccgggacgagatgctgcgcctgggccgcctccaggcggagaaggcggcggccgcctccaagaccacggcggagagcgtcatcgtccccgccagcagccaggaggtcccggtgctgaaggggtccaacaagcactcggactctggcatcatcgtggaggggctgggcaactgtctggtgaagttcgctaagtgctgcacccccgtgcccggcgacccggtggtgggcttcatcacccggggctacggggtgtccgtccaccggcaggactgtcccaacgccgaccccggcaagcgcaagccggaggaggccgcccgctgggtcaaggtctcctgggtggagggcagcctgcccagctaccagaccagtctggagctgtccgccaaggaccgggacggcctgaccctggatgtggccatggccctgtccaccgccaaggtgaaggtgtccgccctgtccgcccgctctatgcccgacggctacgccagcgtcagtgtggtgctggaggtcaaggaccgggaggagctctcttccgtcatcaacaagctgaataacatccagggtgtctaccaggtggtccgggccagcggaaaataa

SEQ ID NO: 2421 - DNA, 2508 bp, Unknown
  Artificiall/Consensus sequence
gtgagcaagggaacggaaaagtcatccttttttgagaaactggccacagtcatcgtcgacaaaagaaacctgatcttttttctctatgcctgtgccctgatcttctgcctgttttcccgaaactgggtcagcgtgtgcaacgacattacagagtatctgccggagaccacggagacccgccagggactgaccctcatggaggaggagtttaccaccttcggcaccgcccgggtcatggtctcccatgtgacctatgagatcgcggaggaactggcggagcagatggagcagatcgagggcgtcacctcggccaccttcgggagcagcaccgtcggcgcggacacaggaggtgacggtgagccggagacaccggaggacatcacggagtatttcaagggggctgacgccctgatctccgtgacctttgacggcgaggaggaggacgagatcagcctcgccgccctggctgccatccgggaactgctggagccctacgactattacattgacagtgctgtaggcaactcacaggcggattctctggccagcgagatggggaccattctagcggtggcggcggtgatcatcgtgctggtgctgctgctcacctcccgctcctatgcggagatcccggtactgctcatcacctttatcgtagcggccctgctgaatctgggcaccaattttattttcggggagatctccttcgtctccaactctgtgaccgtggttttgcagctggcgctggccatcgactacgccatcatcatgctccaccgctttctggaggagcgggagtacgccgaggaccgggaggcctgtatcgcagcggtgagcgccgccattccctccatctctgccagcagccttaccaccatttcgggtctggccgctatgatgttcatgcagttccggataggctttgacatgggcattatcctcatcaaggccattctgttcagcatgctctcggtctttaccctgatgccgggcctgctgatgcttttttccaaggccatggcaaaaacccagcaccgcagttttgtcccaaagatcgaccgctggggcaagtttaccctgaaactgcgctatgtaggcgtgcccttgttcgcagcggccattgtggcgggctttctgatgtccaatcagtgcccctatgtctacggctacagtcagatccagaccgcccgacaaaatgagacccagatcgccgagaagaaggtcaacgagaccttcggcactcagaacgtaatggcgctgatcgtgccaaagggcgactatatcagtgaaaaggccctgctggagcggctggagacctatgaccaggtggactacgccatgggcctttccaatgtggaggtcatggacggctatatgctcacggacgccctgacgccccggcagtttgccgagatgacggatctggactacgagctggtatgtcttgtttatgccgcctatgcagcggagggcgaagagtacggaaggatcgtgggcggcctggatgactatacagttccgctgatggatatgtttttctttgcctatgacaaggtggaggagggctatgtagatctggacgaggaggaacaggcggatctggatgctctctatgaacagctttctgacgcccgagagcagctgctgggagaggactacacccggatgctggtcagtctggatctgccagaggagggggaggagacttttgctttcctccagaccatccatgacgaagcggagagatactatgacgccgaaaacgtctatctggttggggactccaccagtgactatgacctgtctgtgtcctttgccagagacaatgtgatgatcagcgtgctgtcggtggcctttgtcattatcgtcctgctgttcacattccagtcggtgggcctgcccctcctgctgatcctggtgatccagggcagcatttggatcagcttctccttccccggcgtgacccagcagcccatcttctttatgagctatctggtggtgacctccatccagatgggggccaacatcgattacgccattgtgatctcctcctggtacaacgaactgaaggagaagatgccgcggtcagaggctatcgtccaggcgctggatctgtcctttccaacggtgttgacctcggggagcatcctatctgccgccgggttcctgatctcccagatcactacggagccagccattgtgggcatcggcgagtgcctgtgccggggaacgctgatttccatgtttttagtcatgtttatcctgccccagatcctgtacgtgggagacaagatcgtggaaaagacccgcttcaacatcaaagttccggaggtcagccacagcgccagcggcaccgtctatgtaaatggccgggtcaggggccgggtgtccggtgtggtggacgcccacatccaaggcgtgatctacggagacgtctccgggatgctggagactggaagttaccagaccaaggaggttccaaaagcagatgaaacggaaaagcagtaa

SEQ ID NO: 2422 - DNA, 2046 bp, Unknown
  Artificiall/Consensus sequence
ggcggagccatgactgcggtctacaagcgggagctgcgctcctatttcacctccatggtggggtatgtgttcatcgccatcctcatcttttttgtaggcatctacttcatggcctacaacctgttcggcggctacccctccttcggctatgtcctgctcagctgcaccatcatcttcatggtggccgttcccatcctcaccatgcgctccatggcggaggaccggcggggcaagaccgaccagctgctgctcacctcccccgtctccctcaccggcatcgtcctgggcaaatatctggccatggtcaccgtgctgctggtccccatcctgctgatctgcttctgcccgctcatcatcgccatgaacggctccgccactctgacggcggactacgccgctatcctggccttcttctgcatgggctgcgtgtacatcgccgtaggcatgttcgtctccgccctcaccgagagccagatcatcgccgccgtgggcacctttgccgcgctgctggtcctctacctgtggaccgatctggtgtcctttctccccgactccctggcccagctcctctccagcttcgacttccagggcgtgctggacaacttcgcctattacagcgtgttcgatctggggggactgctgctctatctgtccatggcggccgtcttcgtcttcctcaccgtgcaggtcctccagcgccggaaggggatcacctccgccgctaccactgcggtggtgctggccatcgccgtggtggtcaatctggtggtggggcagctgccctctgacctggtggagcgggacatctcggacaacagtctctacactgtcagcgacacttctgtggactacctctccgccctggagcgggacgtggagctggtcgtcctggccagcgaggacaccacggaccagcgcatcaccaaatttctgcacaactatgccgccctgtccggccatctctccctctccttcgtggaccctgtggaacacccctccgccctgacggagtatgaggcagaccagaacactgtcgtggtccgctgtgccgacaccggcaggcagcggggggtccccttctccgacattttggtggccgatctcatgtcctactacacctatggcacctatacctattccgagttcgacgccgaggggcagcttacttccgcggtggactacgtcacctcagacaacagccacatcctctatctcgccgaaaaccacggggagagcgccttgggcggctcggtcaccgacgccatcagcaaggccaacctgtctacctccaccgtcagcctcctgctggacaacggggtgcctgacgactgctccctgctggtcttcaaccagccccagaccgacctgtccgccgacgaggcccagatggttcgggactacctggaggggggcggccaggtgatgatcctgctgacccgcacggacctggccaacttcaatgccatcctcgccgactacggcctcgccatggcccagggctatatcggggacaccgcccggtactatgcccagtacggccgcttctacttcagcgccaccctgtccgcctccagccccatcactgctcagttcggggacgacgacctgactctgatctacgccgcccacggcatgacccagtgcgatccggtccgtgacaccatcaccgtgacccccttcatgaccaccacggagagcggctactccgacgccggcgggcagaccggcacctatatcctgggcgcccaggcggaggaggagaccgacggcggcaccgcccgcctcaccgtcttcaccaccgagagcgtggtggaccagagcatcctcaccttcaaccccagcatggtgaacctggacatcttcctcaacgcggccacctccggcatggaggacatctccgccatctccatccccgccaagagcctggaaatcacctataacaccgttctcaacccgggcatgtggagcaccctctatctggccgtcatccccctgggggtcctgatcggcggcctggcctactggatcaagcggaggaaactgtga

SEQ ID NO: 2423 - DNA, 2244 bp, Unknown
  Artificiall/Consensus sequence
atgccaaagaagaaaaaccccgacgagaccaaacccaaggtaaccaaccccaacgtcatgggcctgcgggccgaggtgctggagcagcccatcaccgagacgctggagatcaactatatgccctatgccatgtcggtcatcgtctcccgggccatcccggagatcgacggcttcaagccctcccaccggaagctgctctacaccatgtatcagatgaaactgctgggcggggcccgtaccaagagcgctaacgtagtaggccagaccatgaagctcaaccctcacggggacgccgccatctacgacaccttggtccgcctctcccggggctacggggccctgctccacccccttgtggactccaagggcaactttggaaaggtgtactcccgagacatggcctgggccgccagccgatacaccgaggtgcggctggaccccatctgcgccgagctgtttcgggacatcgaccaggacaccgtggactttgtggacaactacgacggcaagctgaaggagcccaccctcctgcccaccacctttcccaacgtgctggtctccgccaaccagggcatcgccgttggcatggccagcaacctgtgcggcttcaacctgggggaggtgtgcgacaccaccatcgcctatctgaaggacccggaccacgatctcatgtccaccctgaaggcccccgacctgcccaccggtggtgaactgctctacgacgcctcggagctggcctccatctaccgcaccggacggggctccttcaaggtgcgcgccaagtggcgctacctcaaggcggacaacatcatcgaggtctacgagatcccctactccaccaccgtggaggccatcatggacaaggtggctgagctcatcaagtcgggcaagatccgtgagatcgccgacatgcgggacgagaccgacctgtccggcctgaagctgactatcgacctgaagcggggcactgacccggacaagctgatggccaagctgttcaagtccacccccctgatggacagccagtcctgcaacttcaacatcctcatcgccgggatgccccgggtgatgggggtgcgggagatcctggaggagtggaccgcctggcgcagcgactgcgtgcgccgccgcacatacttctccttgaagaagaagcaggagaagctgcacctgctcaagggcctcaagcgcatcctgctggacatcgaccgggccatccgcatcatccgggagaccgaggaggacgcggaggtagtgcccaacctgatgatcggctttggcattgaccagatccaggccgagttcgtagccgacatccgcctgcggaacatcaacaaggagtacatcctcaagcgcacccaggaggtggactccctggaggaggagatcgctgacctccaggacctggtgaacagcccccgccgcatccgtcaggtcatcatcggtgagctggagcaagtcaagaaaaagtacgccctcccccgccgcaccgatatcgtctatgaccaccagaccgaggagctgctcaccgctgaggaggaggtccccgactacccggtgaatctcttcctgtcccgggagggatatctgaagaaaatcaccccccagtccctgcggatgtccagcgagcagaagtataaggacggcgacggccccttccttacctgggaggcctccaaccgggacgagctgctggtctttaccgacaggcagcagtgctataagacccggctcagcgaatttgaggacaccaaggccagcgtgctgggggactacctgcccaccaagcttgccatggaccaggaggagcgggtggtctgggcctgcatccccggggactaccgccgccagctgctcttcttctttgacaacggcaaggcggcccgggtggaactgtccgcctaccagacccagacccgccggaaaaagctcaccggggcctattccgacaaggcccccctggtctccgccttcctgctggaggaggaccaggagatggcggtctactccaccgaggggcgctgcatgatcttccacacctccgccctctcccccaagactacccgcaccacccagggggtcaacgtcatgtccctcaagcctaaataccgggtggagaaggccctgcccctggctcagacccccatccgcaacgccgcccgctaccgggcccgctccctgcccattgcgggagccctccttcgggagcccgaccggggagaggagcagatgaccctgctgtaa

SEQ ID NO: 2424 - DNA, 2829 bp, Unknown
  Artificiall/Consensus sequence
atgcacagtcatatttttgtcaagggcgcccgggtgaacaacctgaaaaacattgatgtggacatcccgcgggacaagctggtggtcctcaccgggctgtccggttcgggaaaatcctccctggccttcgacaccatctatgccgagggacagcggcggtatgtggagtccctcagctcctacgcccgcatgttcctgggccagatggagaagcccgacgtggactatatcgacgggctctcacccgccatctccatcgaccagaagaccaccagcaagaacccccgctccactgtgggcaccgtgacggagatctatgattacctccgtctgctgtgggcccgggtgggcaccccccactgccccatctgcggcaaggagatcaaacagcagaccatcgaccagatcatcgatcaggtgatggcgctgcccgaggccacccgcatccagatcatggccccggtgatccgaggcaagaagggggagcacgccaagatcttcgaggatgcccgcaagtcgggctacgtccgctgccgggtggatggcatcgcctatgatctcagcgaggagatcaagctggaaaagaacaagaagcacgacattgagatcgtggtggaccgtctggtgatccgggaggacatcgcccgccgtcttacagattcggtggagaccgccgcctccctggcgggggggctggtgatcgtcaacgtggtgggggaggaccgggatatcctgttttcccagaactacgcctgcgaggactgcggcgtctccatcgaggagctcaccccccgcatgttctccttcaacaaccccttcggcgcctgccccacctgcaccggcctgggcagccagatgaagatcgacccggagcgcatcatccccaataaaaacctgtccatcatcgagggggccattaccgcctccggctggagtagcatcaagtcggacggcatctcccggatgtactttgacgccctggccaagcggtacaaattcaagctgaacaccccggtgaaggacctgcctccggaggcgctggacgccatcctctacggcaccaacggggagaagctgaccctctactacgaccagccccgggggaaggggaccctgtatcaggcgtttgagggtattgtcaacaacctggagcgccgctaccgggaaactcagtccgactctgtaaagcgcgagctggaggagtgcatgagcgagtgcccgtgtcccacctgtaagggccgccgcctgcgcaaggagtctctggcggtcaccgtgggggggatcgatatcgacgccttcacccacaaatcagtggacgacgccctggagttcgtggatcagctgaccctgactgagacccagatgcgcatcgcccagcggatcctgaaggagatccgggagcggctgggcttcctgcggtcggtggggctccagtacctgaccctgtcccgcagcgccgccagcctgtccggcggcgagagccagcgcatccggctggccacccagatcggctcctctctgatgggagtgctgtatattctggacgagccctccatcggcctgcaccagcgggacaatgacatgctgctggagactatgaagcacctgcgggacctgggcaacaccctgctggtggtggagcacgatgaggacaccatgcgggccgccgactatatcgtggacgtgggccccggggccggcgtccacggcggacagatcgtggcctgcggcacagcggaggagatcatgaacacccccggctccctcaccggcgactacctctccgggcggcggaagatcccggtgccggagcagcgccggaaggggaacggaaagtacctgaaggtgctgggggcggcggagaacaatctgcgccacatcgacgtgtccttccctctggggaccttcactgcggtgaccggcgtgtcgggcagcggaaagtcctccctggtcaacgagatcctctataaccggctggcctgcgacctgaaccgggccaagacccggccgggcagacacgacggcctggagggggaggagttcctggacaaggtcatcaacatcgaccagtcccccatcgggcgcacgccccggtccaatccggccacctacaccgggctgttcaacgacatccgggacctgttcgcctccacccaggacgctaaaagccggggctacggcccgggccgcttctccttcaatgtgcggggcggccggtgcgaggcatgtcagggggacggcctgctgaagatcgagatgcacttcctgccggacatctacgtcccctgcgaggtgtgcaagggcaagcggtacaaccgtgagaccctggaggtgcggtataaggggaaaaatatctatgaggttctggagatgacagtggaggaggccctccccttcttcgagaacctgccccggatctacgggcggctcaagaccctgatggatgtggggctgagctatatcaagctggggcagtcctccaccgagctgtccggcggcgaggcccagcgggtcaagctggccaccgagctgtccaagcgctccaccggccagaccatctatatcctggatgagcccaccaccggcctgcacagctatgacgtccaccggctcatcgaggtgctccagcgtctggtggaggcgggcaacaccgtggtggtcatcgagcacaacctggatgtcatcaagaccgccgaccatgtcatcgacctgggccccgaggggggcgacggcggcggcaccatcgtctgcacgggcacgccggaggaagtggccgcctgtgagcggagctacaccgggcggtatctgaaaaagatgctggagcggtga

SEQ ID NO: 2425 - DNA, 2814 bp, Unknown
  Artificiall/Consensus sequence
atgatcgaggatcaacatcaacatccgaggtgttttccaatgagtctatttactaaaatcttcgggacctcctcccagcgcgaagtcaaggccatcacgccgctggtggataagatcgaatctctggaggaggagtacaaggccctgacagaccagcagctgcaggccaagacccccgaatttaaggagcgtctccagaacggtgagacgttggacgatatcctgcccgaggcctttgctgcctgccgggaggcggcctggcgggtgctgggcatgcgcccctaccgggtccagctcatcggcggcatcatccttcaccagggccgcatcgctgagatgaagaccggtgaaggcaagaccctggtagccaccctgcccgcttacctcaacgccctggccggaaagggcgtccacatcgtcaccgtcaacgactacctggcaaagcgcgacagcgagtggatgggcaaggtgtaccgcttcatgggcctgaccgtgggcctggtcatccacggggtcatgggtccggccaagaaggccgcctatcaggcggatatcacctacggcaccaacaacgagttcggcttcgactacctgcgggacaacatggccatctactccagcgagctggtccagcgcggccactcctttgccatcgtggatgaggtggactccatcctcatcgacgaggcccgcaccccccttatcatctccggccagggggagaagtccacccagctctacaccatcgtggaccagttcgtctcccgcctgaagtgccagcgcatcgccaaggtggacaacaaggaggaagaggacgtcaacctggacgctgactacgtggtggacgagaaggcccgcaccgccacccttaccgcccggggcatcgccaaggctgagcaggccttcaacatcgagaacctggccgacccggagaacaccaccctctcccaccacatcaaccaggccatcaaggcccacggcgtgatgaagagggacattgactacgtggtgaaggacggacaggtcatcatcgtggacgagttcaccgggcgcctcatgttcggccgccggtataacgaggggctccaccaggctatcgaggccaaggagcacgtggaggttgccaacgagtccaagaccctggctaccatcaccttccagaactatttccgcctctatgacaagctctccggtatgacgggcaccgccatgaccgagcaggaggaattcggcactatctatgagctggacattgtagagatccccaccaacaaacccctggcccggattgaccggcccgacgtagtctacaagaccgaggcgggcaagctgcgggccattgtgcagcagatcgaggagtgccatcagaagggccagcccgtcctggtgggcacggtgtccatcgagaagtcggagcacctgtccgagatgctccggcgcaagggcatcgcccacagcgtcctgaacgccaagaaccacgagaaggaggccgagatcgtcgcccaggcgggcaagttcggcgccgtcaccgtggccaccaacatggccggccgcggcaccgacatcatgctgggcggcaacgccgagttcctcgctaaggctgacctgcgcaaagcgggcatgaccgacgagcttatcgcggaggccaccggattcgcggaaacggacaacgaggatatcctcaacgcccggaagatgttcaccgaggcggaggccaagtataaagacgagatccgggcggaggcggacaaggtccgcactgtaggcggcctgttcatcctgggcaccgagcgccacgagtcccgccgcatcgacaaccagctgcggggccgcgccggccgtcagggcgaccctggtgagacccgcttcttcctctcactggaggatgacatcatgcgcctgttcggctctgagcgagtcatgggcatgatggagaagctgggggtggacgaggacacccccatcgacgctaaaatgctgtccaacgccattgaaaacgcacagaagcaggtggagtcccgtaatttccagacccggaaaaacgtgctccagtacgatgacgtgatgaacacccagcgggaggtcatctacaagcagcgccgccaagtgctggacggcgaggacctccagcagtccatccagtccatgctgcgcagcaccattgagaacgccatccgcggccacatgggagagcagaagcatatgactgcggaggagttccgggaggccaccgctctcttccacaccatgttccttttgccggacgaactgcggctcacagacgaggagctgcaaggctacactgcggacgggctggtagatctggtcatggagaaggcccaggctgtctatcaacgcaaggagcaggaattcacaccgcccctgatgcgggagctggagcgggtcatcatgctgcgggtggtggacgagtactggatggaccagatcgacgccatgaatgacctcaagcagggcatcggactgcgggcctacgcccagactgaccccgttgtagcctacaaaaaggaaggctacgagatgttcgagcagatgatcgctgccatccaggaggagaccctgcgccgcctgttcctggtgcgcatccagcgcaaggcgcctgatgcccccgccccggagatcaaacgggaacgggtggccaagatcaccagcgagtcaggcgccagcgacggcacggtcaaaaagcagccggtaaaaaaggcggtcaagatcggccgcaacgacccctgcccctgcggcagcggcctgaagtggaaaaagtgcacctgcaaggagtatcacagcgagcagcagtaa

SEQ ID NO: 2426 - DNA, 2139 bp, Unknown
  Artificiall/Consensus sequence
atgacacgtttctcccaagtgaccgccgccctgcggcggaagagcctggggcagtatgccctgctcaccctgtgctgtttcgtctccgtgctcctcatcaccgcctacgcctccatgatgggttcccccacggtgctctccgtctttcccgaggggggcgacagccgcaagcagatgaccatgatcttcgtgctggctgtcctgggctgcggcgtattcaccacctacgcctccggcctgttcttccgccacaagtcccgggatgtgggcatcctgctggccctgggtgcctccaaggaccagctgcgccgggtgctgacgggggagctggctctgatgtccctgtctgcctgtgccctgggtgccctgctgggcaccccgctggcctggttcatctggcaggggttccggctcctgctggtggactcagaggagatggccctggcctttgacccccatgcctatctgctggccctggccttctccctctttgtggttgtcatgctgtttgttatgctgggccgctttttgcggcggaccaacatcctggacgtggtcaacgagtcccggaagtctgagcccatccgtgcggtcccccggtggtacggtcctctgggcatcatcctgctggcggcgggcggctttctgggctatatggcccccaaattttttattttggtcctccactggtacgcccccgacgccctgacggccctgttctatctgcccgccctggccggcctctacatgatcctcctccacacggtagtcaacggctggcggcggggcagcagccgctacagggacctgatcacctccagcatgatgaagttccagggacgccagaccgtgcggaatatggtggtggtgacggtgctggccgccggggcctactttgccgctttctatatccctatgctgagcagcggcacctcgtccacaacggaggaccgggaattcgattacctgttccactaccgggctgaccaggacatgcccggccgggaggaggtgctccatctggcagaggagatgggagtgactgtcacccgctacgcccagcagtccggtgcggtgctcgcctacgacggctacgccgatgttgtatcggagggccccctgggcgccacctacgatgtggtttactgtgaggaaactgcctctgatgtgttcctgtcggagagcgcctggaacatccttaccggggatgacctggatctggaacccggtacagcggccacagtctatgaccgcaacggggatagcagcggcgccgggaacagcatctccctggtcaccaaccacctcaccggggaacagctggccgtcacgccggccgagcccctgcgcagcacctcccttctgggataccgggtgctggacgacggggattatgcccgcatcacccagggcctgcccgatgaatggcgggaggtggtggccgtctttgacgtggaggacgaggaggacacctacttctttgcaagggccctgttcgacgagatcgtggaccgctccggccccgaggtggccctcttcgacggttgggacccggtggtccgggaccgttatctggcagagaagggctactacttcctggacccggcccatctggaacccaatggattttctcccattgaatatgaccagcgggattccagcaacttccggaattcctggaaatacatgccccgcttccgggtgctggaccaggcggacttcaccactaccatggcggtctttctgatgctgttcgtctttgtctccatcgtctgctttgccgctatggtggtcatcctctttacccgctgcatgaccatcgccatgaccaacgcccgggtctatgacgacctgcggcatctgggggcctccaacgccttcctccgccgcacggtaaaggggcagatctcccgggtgttcttcgtccccctgtgcacgggcaccctgctgatctacgccttcttcgccatgatcctgtacttcaacagcggcagcttcactcccggcgagctggccggcctggccaactgcgccctggtggtcctcgtcctctctctgttcttatatggcatgtaccgcttcaccctgggccgggtatgctccgccctttccatccggtcctcttcccggccccgctga

SEQ ID NO: 2427 - DNA, 4755 bp, Unknown
  Artificiall/Consensus sequence
ttgtttggaacaacagttacgactccactaatgagtgtcccgatttatgcacaggaaagtagaattgctccaactaatcaatattcagttgatcaagtaactactataactaatggatcaggggcgattaatgccagtgaagatgttgcaaactatgctaatttagatcagtttacattaaatggaactttcagttttacaagcaacagtaatagtggtgttaatgcaatcttctttataggagataatacgactgcaaacaattattttacgttgtatgcaattccaagttcaaaaagattaggagtagagttaagaaatatttctggaaatcagatgttaagtaattcttatgtaactcttaatgatgtcgattttacgatggaacataaagttacttttacaatgtctaaaaataactatttccgtatttatttagatggaaaaaaagtattagaaggaaatgcaccatctggctttactaatgaagtaattgataatcctaattatatgggatttggtgttggaagtagagctagtggaaataattatccaatgactggtaatttaaaaaatttagaattgtacaattgtgctttaagtgaaagtgaaattatgtcttatcatttaggagcacttgaaagtattgcatataaatatgaaaatatttattatcaagatagtaatgtgcaaagagtgcaagataatgaaaatatttctaagttagtttctatggatagtggaagtatttcaattagatataaagttaatgatcagaatttaggaagaatgtcattgttttctatctcagataatcttagtgaaaataaatatatagatttatatgtagatccaagtaacaatatttttggattagatgtagaaggaacaaaagattttgttatgccaactacatcacttaatcgagctaatcgaacagtcaaagatacatcttggcatacaattacgattacaaaagaaaatggtaatgctaaaggatttatgttttatttagatggggcttatgttgataaatatacttcagcagttccagaaggattctttagtcttttagctgatgctaatgctgttaactttggttttattgatacatcaggagatgacttagaatcattgacaggtgcaattgattatgttagagcatacaatgaaatattagatccaagtacaattttacaagaacatactctaacaaattggcaacctggtcaagaaatcgatatgactaatgcaataaaaacagaaaatgaagatttatattatgcgggatatgaaaattcaagttcatatcgaattccatcattattaaaaacttcaaaaggtaccttattagctgcaattgataaacgaattacaggtgcacaagattgtggaaatattgatattgcagttagaagacgtgaagctaatcaagaaaattttggagatccaattattattaacgatttaatttctaatccaaacaatccttcatcatcagcttttttaattgatagtagcatggtcgaagataaagaaacaggtcgtatttttttgcttgctgacatgtttccagaatcttctgggttaatggatacaagtcagttaacaacaggaacaggatataaagaaattgatggcgttgattatttacagttatttgaccaagcaggtaatgaatatactgttagaccggaagatggatttgggtatgtttatgatagtcaaaataataaaactggctatacagttattttagaaagtgatgctccatatcacgaacgtggtagcctttatttaaatggtgaatataaaggtaacatttatatgttaaaaaatggacctgaaaaaggtgaattacatgtattaaatacacaatatttatggttatattattctgatgatgatggtaaaacatggtctaatccaattgatataacacctcaggttaaagctgattggatgatgtttttaggaacagggcctggcgttggaattcaaatggaagatggtactctaggttttccagtttatagtgcaaataaaaatgttggaggtagccagtcttcagctatgattattagtaatgatggaggaaaaacttggcagttaggtgattcaccacaaactaatatgggtaatgaccgtgaaacaatgaataatagcggtaaaatgtttacagaatcacaagcagttcaattaaataacggacaagttaaattatttatgagaaatacttatgcaaacaaggtgtatgttgcaacaagtagtgataatggattgacttgggataaagtagaacaaattgatattaatgaggtatattgtcaattatcagtaactaattttactcgtaatggaaaagaatatgttgtaatgacaaatccagatcattctccaagaacacagggaatggttcatattggtgaggtagatcaagcaacaggtgatattacatggttagatagccaaattttaaatacaggaaaatttttatactcatgtctaagcgtattacaaaatgatgatgaagatgttcgttttggtttgttatatgaagatgatactgatggaacatttagaataaagtatacagaatttaatgatgattttatttatgctggaactaaaacggaagaattaaaagatccaaaattagtagattataacgttagttttgataatgataaaattaatgtagctttaacatttgatcaagaactactagcaattggaaatccacaattaaaattaaatgtaggtagtcaagaaataattgctgattataaagaaggttctagcagtgatacaatctttttcgaagctacattaccaaaacaaatcaatggtgtaatgaaagcagtcgaattacttgaaactaatggtattattgaaaatattaaaaatggtaaagtagctgtattaaatactaatatttacgattttactgaaattactagcggtattactgtttctagctatacatcacaacattcatctagtactgcagaaaatacagatggtgcagcagttaatgttattgatggtaatataaatacatattggcattcaacatggggaaatgcaaatatcaacttaccacaatcagtaactctaaaattagataaaacaaaaacactatataaattagcatatacaccacgtcaaaatagtaataatggtagaattaaagaatatgaaattgcaacaagtattgatggtaacgaatttacaacagttgcctcaggacaatgggtagatagtaaagatattcaatatgttgaatttattcctactgatgcaaattatattaaaataacagcaacagaagcatatggcggtggtgcaaaacaaagttgtaatattgcagaaattggtttatttgaatatagtgatggggtaattaatgtgggtgataaaactgcattaactaacttagttaatacagttaaagatttagatacatctatttatgcaaaacctacagttgataatcttattaatgcaataaatgaagctcaaaaattattagatacaaatcttgtatcacaacaaatgctagataatgcatatacaaaattaataaatgcaaaaactgcattgattaatattagtaaagctactaatgcactagcaaaattagatgaactaaaagaagaaaattatacaccagaatcatggcaaatctttatcaatgaattaacaacattaaaagaacaattaaatgatataacatcatcaagagaagttttagatattgttgttaaagcagattatattgaaagtcaattaattaaggcagaaattacagatacaaataaaacagcattaaagattgcaattgatatagcaagcttaatcagtgaagaaagtttagaaaatgtaatacctgttgtagttgacgaattcaaagcagcattaagtgaagcaaatgaagtatacaataatactagtgctactcaaaaagaagtaaataatgcatttgatcgacttgcaaatgcaatgcaaaaattagaattttataaaggcaataaaactaaattaattgaggcaatcgaagaagctaacagtaaacaggaagaagattatacagcaaattcatggaaagcattgcaagaagcattacaagaagctaataaaatattagctgatgaaaatgtaatgcaaaaagaagtagatgaagcaacaaataaattacaagaagcacttgataatttagtaacaacagttgataagagtttattacaagtatttgtagaatatgtaagtggattagattcaaataaatatacagaagctacatggaaagcatttgaaacagaattaactgaagcaaatgtgatattaaaagatgcaaatgcaacacaggaacaagtagacaatgcttataatcaactagtaaaagcatacttagatttaagattaattccagataagagtttattagaagaattaatcaataaggcagaaggattaaacgtagcaaattatacaaaagcaacatttgatggcttaacaaaagcattaaatgaagcaaaagcagtatatgaaaatccaaatgccactcaaaaagaagtagatagtgcaaaagctacattagaaaaagcaatcaataacttagaagtaacaccaataaataatggtgatactacaagtgtaaaaactggagattctagttatattacaacaagtttaggcttgattatgacatctggattaattgcaagctatttaaaaaagaaaaagaaatcataa

SEQ ID NO: 2428 - DNA, 5139 bp, Unknown
  Artificiall/Consensus sequence
atgagaaaacagggaagtaaacttcttttagtagttttgacttttttcatgatatttggatgtgtaaatgtatatccggttaaagcaaaaactactcaaaaagagtatgagatttatccaaagccacactcgattaattacgaagagggcaattatagtatcgatgctattaatattgtatatgaaaatggaattgatgctgatactaaaattagactgaacgaaattttgacaacatatgaaattgaaggaagtgtttcaaaagaaattcaaaatggaaaaactaacattttagttggaattaataattcaggtgaatttgttgatgaatatgttaaagcaaattatttattgaatgatccagatttattttcaaaattagattcatatttattaacatcaagaaatgatattattacaattcttggtaaagacagcgatgctgcattttatggaattacaagtttatatcatatttttaatcaattagataataattcaatttgtaattttacaattgaagactatgcagatgtagctagtcgtggatttattgaaggatattatggaaatccttggtcaactgaagatcgtgttcaattgatgaaatggggaggatattataaattaaattcatatttttatgctcctaaagatgatcctaaacataatgcaaaatggcgtgagttatatagtcaagaagaaattgaaacaaaaattaaaccattagcaaaagctggtaatgaatcaaaatgtcgttttgtttttgctttacatccatatatgaataatccaattcgttataattctgaagacaattatcaagcggatttaaaagttatgcaggcaaaatttgctcaagttattgaagctggtgtacgtcaaattgcaattttagctgatgatgctggaaatgtcggaagccaaaattatataagaacattaaatgatatgactgcttggatcaaagaaatgcaaaaatcttatccagatttaaaacttacattaccattttgtactcaagagtacatgtataatggagaaagctattatcgtgattttcctgaaaatgttcaaattgttatgactggtggaagaatttggggagaagtatcacaaaattttactaatacttttacaaataatacaggacgtggtccatatttatggattaactggccgtgtacagataattcaaaaaaacatttaattatgggtggatatgatactttcttacatccaaatgtagatcctgaaaagattcaaggaattgtattaaatccaatgcaacaatcagaaccaagtaaagttgcaatttttggtaacgcctgctattcatggaatatttgggaatctaaagaagaagcaaatcaatgctggaatgattcatttaaatatgttgatcataataattcaactgaaactgaagcttcaaatgcattacgtgaactttctaaacatatgattaatcaaaatatggatagccgtgtaacagcattacaagaatcagttgatttaaaagatcgtttaacaacatttaaggatttattaaataaagatgctacaatcgatgaagaacttattgatgatttaattaatgaatttaaaattttacaaagtgctgcaaaagtttatcgtgaaaacgctggagataagcgaattagagatcaaatcatttattggttaaattgttgggatgatacaacaaatgctgcattatcatttttaaacggtattaaagctttacagcaaggtgctgatagttcattgatttgggaaaacttttcagctggacaaagtgcttttgcaaaatctaaaacatatggctttcattatgttgatcaccttgaatatgctgaagtaggggtacaacatatcgtaccatttattaaagcaatggaatcttatttatcgcttaaagtttcaacaattgttgatccagataagcaagtaatttcagttattactaaccgcaatgatacaccaacgcaatcaactgatttaatgttagatggtaaagatgatacttttgctcaatggaaaacacctaattcatctaaagttggagaatatgtaggaattacatatactaaagcaattgatttaaaagaagttaaattcttgatgtcaaattctgcaacaaacaataaaaatacttttattaaagcaaaacttcaatatactgaagatggaaaaatttggaaagatattgaaggaagtgaagttggaaacaaggcattacaacttagtgcaactggtttaaatttatcggttaaaggaattagagttatttgtagtgaagctacaccagatatttggctagcaattcgtgaaatttatgtaaacggtaaaagcataaatagtgtggaagatcaatttaatccaactgttattaaaactaatacatatcgtgtatatcaatcatacaatgaatcaaatttaacagatggaaatgataatacatttgtatggtatcaaactaatagtggtgatatgagtttagttggtgattatgttggattagatctaggtaaagtagttcctattgataatgttcgttttattatgggaaatggtgattattggagtaattatgatttggaatattcattagatggtaatgaatacactaaatttaaatcttatagtcaagacacgaataaaaaaattgttgaagaagattttaatggtattcaagctcgttatgttagagttaaaaatactaaagataaacatacttggttaaaaatgtcagcatttgaagtaacaccaattttatctagtggtaatgttgatacaaataatgatgatttaaaatcaattacaattgatattacaaatgatacaggatcaattactccaagtgataatattacattaaatcctcaagaatatattggtttaactttaccaagaattagagatttatctaatattgatttacaattagtaaatggtgaagatttaacattacaagtatcaaaaaataatgttgattggcaaaatattgattttaatgaattgcctgatggacgttatataagattaatcaatcaaacagataaagcgattacttttaatattacaaaatttgtagttacatcttttgaaattacaacaccaacattatatgatacaaactttggaatcactccaggatggggagaaagtgaagactgtcgtgataatggagcagcatttgataataacattgatacaattactgaatttggtactttaccacaaaaaggtcaatatgcaatttatgatttaggtcaagtacgtaatatcaataaaattgcaatgtattgtcaagattcggctgttaactatcttcgtgatgcagaaatcttgatttcaaatgatttaaatgaatggactaaagttattacaattggagatggtattgaaaataaaaatgatgctaatgtaaaatgtatcgattcagatgctgggtataaagcttcaagtacatatcctaataaagtatatgtagaaggtaatgtagataacatcgaagctcgttatttaaaaatcttagctactgcaactaataataatcgtgctgttgtatttaatgaaattgttattaatgatggtgaatatgttaaagtttcaaacaatccaacatttgcatcaaacgtaattgaagtagcaggttttgtcccagaaaatatgtttgatggtgatttaacatcggcatataaaccaaatactaaagatgctggatatattagttatacattatctgaaaaattggatgttaaaaaaataaatattgttcaaagtggtagtgtatctaaggctaaagttttagtgttagttgaccaagatggtcaaagacaatgggtagaagttggagcattggataaatcattaaatgaaatatacttaccattctggaataatatctatgaattaaagattgaatgggaagtaaataatatacctacaattgctgaaatagttttattaaatgattcaaaatatggggttgatcatagtgaattaacaaactatatcaatagtttagaaattaatgaattagaatatacagcttcatcatatcaagcattttcaaaagtattagctgaagcaaaagctattaatagtgataataatagtagtgcaagtagtgttgataaagctttagctgatttaaaagaagctgtaaataatttagtaaaacgtggtaatacacaattaattaaagataaattaaccgaaattgaagcattaattgaaacagattattcaccagaatcatggcaaaaattacaagtagttgtcaatgaagctagtgagttattaaataaagatgcagctgaaattacattagaagaagtgtctagtattattaataaattagatgaagctatatctaatttagagattaaagctgataaatcattgttacaaattgctatagaagaagctaaaaagattacagatgaacaattaaataaagttgtaccaatcgttgttgaagaatttaaagcagctttagaagaagctacagaaattttagctgatgataatgcaactcaatctaaaatcaatgcatcatttgatcgacttgcaagtgtaatgcaaaaattagaattctataaaggtgataaaaaggcattacaagaattagttaataaaattacattactaaattctaacgattttactaaaataagctgggatcaattaatacctgtattaaatatcgccaatcaaatcttagcaaatgaaaatgctttagtaaaagaagtaaatgatgcatacgaagcattagttagagcatatttaaatttaagatataaaccaaataaagatttattagaagatttaattaatacggcttctaaattaaatgctaaagattatacagttgaaacatataatttattacaaacagttttaaaagaagcaaataatgttttaataagcgaaactgcaagtcaagaacaaataaatcaagcatataataacttaaacaatgcaattaaaaatttagtaaaagttaatcaagaaatatcatcaaaacaaacagctttaaaaactggagatatatcgattacaccatttgtattacttgcaatgttaagtattgtatgtttacttacaatttgtaaaaaagaaaatatttaa

SEQ ID NO: 2429 - DNA, 2160 bp, Unknown
  Artificiall/Consensus sequence
atgaaggtaattaaaagagatggacaaaaagttgattttgatgcatcaaaaattgaaaatgcaatcttaaaagcgatgaaatgtggtagcggaattgttgataccaaatgtgctcatgatattgctgttgaaattgaaaaatggcatgagtttgatggaaataatatttcaatttatcgtattgaaggacaagtttttgaaaagttaattgaaaaaggacaaattttaacagctaaggcatatgagggttatcgtaaggtaagagaatttcaacgtgaaactaatacaatcgataatgaaatttatggaattgttaatcaaactaataaggaagcaatggaagaaaactctaataaagatgctactgttttagcaactcaaagagatttgattgcaggtgaattttctagagattattgtcgtagattgttgttgcctccaaagattgttcaagctcatgatgatggaattattcattttcatgatatggattattatattcaaaagatgcataattgcgatttagttaatttaaaggatatgtttgctaaaggaacagtaattaatgataaattaattgaaacacctaaatcattgcaaacagcttgtacagttgcaacacaaattgtacaacaagttgcaaatggtcaatatggtggacaaacgatttcattagctcatttatctccatatgtaagattaagctatgaaaagcatcaacgtaatgttcgtcgagaaggtcaattagtaggaatagattatactcaagagcaaattgataaaattgctaatgcaagattaaaagatgaaattaaagcaggaattcaaacaattcaatatcaaattaatacattctctactacaaatggtcaagcaccatttttatcagtatttatgtatttaagagaagagcctgaatatattaaagaaacagcaatgttaattgaagaaacattaagacaaagatatgttggaatgaaaaatccagttggagcatatgtaacaccagcatttcctaaattactttatgtattagatgataataatgtacctcaagatagtgaatatcgttatttaacagatttagctgtaaaatgtgtttctaaacgaatgatgcctgattttatttctgctaaaattatgagagaaaattatgaaggtgaagtattcccatgtatgggatgtcgtagtttcttatcaccttggaaagatgaaaatggcgaatataaatggtatggtcgttttaatcaaggggtcgtaacattaaatttagctgatgcgggattatctgcgaaccataatcttgaagttttttggaagattttagatgaaagacttgaattatgtaaagaagcattgttattaagacatgaaagtttaaaaggaacagtcggtgatgttagtccaattcactggcgttatggagcattagctcgtttaaaaccaggtgaaacaatcgataagttattagaaaatggatattcaacaatttctttaggttatattggattatatgaatgtgttgttgctttaattggtagtactcatacttctaaagaaggtaatgaactagcaacaaagatcatggagcgtttaagagaagcctgtgatagttggaaaaaagaaacaggacttggatttggtttatatggaacgccagctgaatcaactacatatacttttgcaaaagcattgaaaaaacgttttggaattgtagaaggaattacagataaagattatttaactaattcttatcatgttaatgttagagaacatattgatgcctttgataaacttggaatagaagcaaaattccaaaaactttcatcaggtggagcaattagttatgttgaagttacaaatatgtctgaaaatttagatgctcttagtgaattgattgattatatgtatgaaactattcaatatgcagaaattaatacaaaatctgattattgccaagaatgtggttatgatggtgaaattttattagatgaaaatcgtgaatggtattgtccaaattgtggtaacagaaatcataaaactttaaatgtgtgccgtcgtacttgcgggtatttaggtgataatttctggaatcaaggaagaactcaagaaatagctgaacgttttgttcatttagataatcacttactaggtgagtag

SEQ ID NO: 2430 - DNA, 2271 bp, Unknown
  Artificiall/Consensus sequence
atggctaagattaatattgatggtgtacagaattgtgaagtaagcattaaaattccttgtgaaaaatcaccacttgaacaattagaaatcatggaagcttatacaaaagcttatcaagaaagtgctaatttagataaggcaagaagagaaatcaattgtttaaaagtaatttatccaactttatttagatcaattgaagaaactgatttaattgctggacgtttagattttttgccaattggctttggttgtgtcacaagtgttggtggcgtaggtcattattgtgtatttcataaactaagagaatttaaagaattattggacactgaaaagcaaaaaacaagagttgatgttttatatgatttttggcaagaacatgatgtcaaagcattatattgtcaagatattttaaatgatactacaactggtagatttattgattgtaaatacccatttatggctactgctagactttctggaatgatgttggattatcaaaaattaatgaaattaggaataaatggaattattgatttacttaaagaaaaaaatcaaaatgaatttattaaagcatcaattgatgctatgatattattaaaaaatgtaatcgaaagacaaaaagagctagttaatgaagcaattgaaagaacaaataatattaatcgtaaaagcgaattaacattaatgtataatagcttagattatattaaagaaaataaaccaaaaacatttcatcaagcattacaactattttggatttatgctttatgtgctggagttatcaactatggaagaatggatattgttttaggtccctatttaaaacatgatcttgataatcatattattaatgaagaagaagcctatcgttatataaaatcattatggttaatgattgaaaatagacgaacaactgttaacggccgaattattgttggtggcgctggaagagaaaatgaagaagcttgtgatatgtttacccgtctttgtttaaaagtatgtaaagatacaagatatgtagaaccccaatttacattacgtctatataaaaacactcccgaagatattaaagatctagcctatgaatgtattgcttcaggagctacttatcctactctttataatgatgaagtaaatattccagcagttgaatatgcaatgaatattgatcgaaaaaaagctgaacaatatgttccctttggctgtggtgagtttgttatccaaggtaaaagtgtcggaactccaaatacattattaaatcttgtaaaaattatgcaattagcacttaatgaaggatatgatccaatagatcatatttataaagccggtccaattaaagttaagccattaagtgaaatgaaaacttttgacgatttttataatcagtataaaaaactattagattattattttgatttaagtgtggaagcacagcttcatagttataaagtcatgaatcaagaagtatcatttctatttacatcaattttaatggatgattgtattaatcgtgaaaaatcattacttgatggtggtgttgaaattttaggtggcacaaatgaaacatatggtaatattaattcatcagatgctttatatgcgataaaaactttagtatatgatcaaaaaaaatatacattagaacaactaaaccaagctgcattacataattatgttggctatgaaaagattcaaaaagatattttagatcttcctaaatatggtaatgaccacaaagaatgcgatgaaatggcaattgatttatatgaatatgtcgctaaaggaatcagacaaagagggatagataatcacatggattattatttaatcgtaatctctaataatcaaacaaacactgattggggtcatcaaacagatgcatctttagatggtagaaaaaaaggaatatatatgaatcccgcaaataaccctcaaggtggtgcagcaaaaaatggacctactgcctgtttaaattcattagctaaatttaatgcaaaatatcatggtggcagtgtacaaaacatgaaatttactcctagaatgatgcacgaggataaagaaaaagttaaaatactatttgatacttactttaaaaaaggtggttgccaactaatggtaacttgcgttgatcatggtgttttagaagatgcacaaaagcatcctgaaaattatcctgatttaatcgttcgagtagctggttatagtgctgtgtttgttaatttaacccctgatattcaagccgagttattaagcagggctctttatgattaa

SEQ ID NO: 2431 - DNA, 3219 bp, Unknown
  Artificiall/Consensus sequence
atgccaaaaagagaagatattaataaggtattagtaattggttctggaccaattgttattggtcaagcttgtgagtttgattattcaggaactcaagcatgtaaagctttaaagaatttagggtatgaaattgtattggttaattctaatccagcaactatcatgactgaccctgaaactgctgatgttacttatattgaaccattaaatctaaaaagattaacacaaattattgaaaaagaaagaccagatgcacttttaccaaatttaggaggtcaatctgcattaaatttatgttctgaattaaatcaagcaggaattttagataaatataatgtagaagtattaggtgtgcatgttgatgcgattgaacgtggtgaagatcgtttagagttcaagaaagcaatgaatgaattagggattgaaatggctagaagtgaagttgctgaaactgttgaagaagctttagcaattgcagataaattaggatatccagtagttgtacgccctgcttatactatgggaggtgccggaggaggacttgtttataatgttgaagaattaaaaacaattgtttctcgtggattacaagctagtttagttaatcaatgtttgattgaagaatcaattttaggttgggaagagttagaagttgaagttgttcgtgatgctaataacaatatgattacagtttgctttattgaaaatatcgatccattaggtgttcacacaggtgattcattttgtagtgcgccgatgttgacaattagccaagaagtacaagatcgtttaaaagatcaagcatttagaattgttgagtctattggtgttattggtggaactaatgttcagtttgctcatgatccagtaagtgatcgtatcgttgttattgaaattaatcctagaacttctcgttcatcagcattagcctcaaaagcaacaggttttccaattgcgttagtatcggcaatgttggcagcaggtttaacaatggaagatattccttgcggtaaatatggaactctagataaatatgtaccagatggtgattatgtagtaattaagtttgctcgttgggcttttgaaaagtttaaaggagcagaagataaacttggtactcaaatgaaagctgttggagaagttatgagtatcggtaaaacatataaagaggcttttcaaaaagctattcgctcattagaaattgggcgttacggattaggatatgctaaaaactttaatgaattatcaaaagaagaattattacatatgttagcaactcctactagcgaaagacaatttattatgtacgaagcattgagaaaaggtgctactgttgacgaaatttatgagttaacacaaattaaacattatttcatcgaacaaatgaaagaattagttgaagaagaagaaaatattaaatcatataaaggtaaagaattaccagtagatatattaaaacaagctaaacaaaatggattttctgataaatatttaagtcaaattttaggtgttgaagaaaagacaattagggaagaaagattgaataatggaattaatcaagcttgggaaccagttcatgtaagtggtacagaaaataattcatattattattctacttataatgcacaagataatagtgatatccatcatgataaaaagaaaattatgattttaggcggtggaccaaatagaattggtcaagggattgaatttgattattgctgtgtacatgcagcattagcattaaagaaattaggatttgaaacaattattgtaaattgtaatccagaaactgtttctactgattatgatacttctgataaattatattttgaaccattaactttagaagatgttttaagtattcatgaaaaagaaaaaccagtaggtgtaattgctcaatttggtggacaaacaccattaaatttagcggctcaattaaaagaaaatggagttaatatcttaggtacaacacctgagacaattgatatggcagaagatcgtgatttattcaatgaaatgatggaaaaattagaaattcctatgcctgaatcaggaatggcagttgatgtagaagaagcattaaatattgctaaaagaatagggtatccattaatggtaagaccttcatatgtattaggtggacgtggaatggaagttgtttatgatgatgaaagtcttaaacaatatatgaaagcagcagtaggggtaacacctgatcgtccgattttaattgaccgtttcttaaataatgctatggaatgtgaagctgatgctattagtgatggtgagaatgtatttgttcctgcagttatggaacatatcgaattagcgggcattcattctggagattcagcatgtatcttaccatctaaacatatttctattcgtcatttggaaacaattaaagaatatactaaaaaaattgcaaaagaaatgaatgttcgtggtttaatgaacatgcaatatgcaattgcagataataaagtatatgtattagaagctaatccaagagcatctagaacagttcctttagtatctaaagtatgtaatattaatatggttaagattgctactgatattattactaaagaattaactggacgtccttcaccagtgccaaatttaaaagaaaagaaaataccacatattggagttaaacaagctgtattcccatttaatatgttcccagaagtagatccaattttaggacctgaaatgcgttcaacaggagaagttttaggacttgctagttcatatggtgcagctttatataaagctgaagaaggtgcgaaaactattttgccaacagaaggtaaagtattaattagcgttagcgatttagataaacctgaagttgttgaattagcacaaggatattatgatgctggatttacaattgttgcaactggtaaaacatatgaattaattaaagaaaatggtgtaccagttgaaaaaattaaaaaaattcatgaaggaagaccaaatataacagatgctcttacaaatggagaattagcattaattattaatactccaaatggtaaacaaagtgttcatgatgatagttatattcgtaaatcagcaattaaaatgaaaataccatatatgactaatattgcagctgcaaaagcttcattagaaggtattatggaaatgaaaattcatggtagtcatgaagttaaatctttacaagaatatcatgctggaattaaataa

SEQ ID NO: 2432 - DNA, 4941 bp, Unknown
  Artificiall/Consensus sequence
atgaaaacaaaatgggacaaaaaaatgtcagtagcattaactgctacaatgatgttatcagttgctccagtaaatgttttagcaaaaccagatgctaaaattgttcaatctgaacctgaagaggtttatgttgacattattggagaaggacagcgttctactttattcaatgaaaattggaaatttcatcgaggagatgtagaaaacgcacaagatgtaaattacaatgatacaacgtgggaaaatattaatttgccacatgattatagtatcgatcaagaatttacaactagcggagaagctgaaagtggatttttacctggtggtgtaggatggtatcgaaaatcatttgttgtaccagaaaagtataaagataagcaacttatggttgaatttgatggtgcttatatgaatgcagaggtatatttaaatggtaaaaaattaggagaccatccatatggttatactgcttttgcatttgatcttactgatggattaatttgtgatggtaaaacagaaaatgttttagtagtaaaaactaataatcagattccaagtagtagatggtattctggtagtgggatttaccgtgatgtaactttaactgtaactgatgatgttcatgtaggatacaatggaactcaaattattgctcaagatttagaagctaataaaaatgggacagtagaagttgatattacaacaactgtagaaaatgatagtgatacaactaagacagtaacagtaaaaaatactttgcttgatgaaaatggtgaagttgcaagtaatacaacaactagccaaatagaaatggctgctgatagcactcaagatattgaacaaagtgtgaatgttgaaaaaccagaattatggtcagtagatgacgctaatatgtacaaaatgaaaacggaaattttagaaaataatgaagttttagatacatatgaaactgattatggattccgttattataactttgataaagatactggtttttcattgaatggcgaaaaaatgaaattaaaaggtgtaagtatgcaccatgaccaaggatcacttggagcggttgcaaatcgtgacgcaattgaacgacaagttaaaatattaaaagaaatgggatgtaatgctattcgtgttactcataatccagcagcttcagctttactagatatttgtaatgaatatggtatgcttgtaattaatgaagcatttgatggatggacagagtataaaaatggaaatgtaaatgattatacgtcacattttgaagaaactattactgcggataatcaaattattaatggtgaaccaggaatgcagtggggagaatttgatactaaagcaatggttgatggagctaaaaatgatcctagtgtaattatgtggtctgttggtaatgaaataacagaaggagtatatacggatacatctcattatattgatgtagcaagtaatattattgattggattcaagaaattgatactactagacctttaactattggagataatcaaaaaaataccaatcctaatgcgatgattagtaaaatagatcagaaaatttatgaatctggtggtgttgtaggattgaattatgctagtaatgatcaaactgttgcaatgcataatacttattctaattggccaatatatggttctgaaactgcaagtgctgttcatagtcgaggaatttataatgtaactggtagagataatgcaaatttacaaatgtctgaatatgataatgatgaggccaaagtaggatggggacattcagctagcgatgcatggagttttgttattaaaaatgattttaatgctggtgaatttgtttggacaggatttgactatcttggagaacctacgccttggaatggaactggtgctggatcagtaagtggtcaaggagcaaaacctaaatcttcattctttggaattgtagatacagcaggtttccctaaagatacatattatttatacaaaagtctttgggatgaagatagtacaactttacatttgatgtctacatggaataataatgaaattgttaaagatgcaaatggaaaaatcaaagtagatgtatttactaatgccgctaaggttgaattgtatttaaatggtaaaaaaattggtgaagatagtgctactaaacatacaacacctttgggctatacttatcaaacattctctaatggagaattttatccaagctttaaagttgattgggcagcaggaaaattaagcgccaaagcatatgatgaagctggaaatttaattagtgatactgaaggaagagatagtgtatcaacaaatagtgatgcaacacaattagatgcatacgctgataaaacagaaataatggcagatggaagtagcttgtcttatattactgttgatgttaaagatgctaataataatatagttgctggagctaataacaaaataaatttctcaattgaaggagaaggaaagattgttggggttgataatggaaatcctagtgacacagatagttataaaggaaattcaagaaaagcctttagtggaaaagctttagtaattgttcaatctacaaaaaatgaaggatcatttacagtaactgcaagttcagatggtttacaatcatcaagtgtaactgtaaatacaaaacgtcctgaagttgaaggggacacttatttacaaagttataagatttctaaaaatatgtatgttggacttggacaagaaccagaattaccacaaacagttgtaggaacttataacaatggtgaagtaaaagtattgaatgttgaatgggatagctatgataaatcaaaattaaatactgttggagaatttacagttactggaaaattacaagatagtgatgcgattgtatcagttacaattcatgtaattggtaatgtagttacaatggaaaattattcaacagtgactaatgttggggttgcaccagaattaccacaaacattacgcggtttctatgaagatggaaaatatagtgaagctttccctgtaacttgggatattcctgaaggtgcttttgcaaatgaaggtattgtaactattaatggaactgcaagtgtattagatggaactaaaaatgttacagcaacaattagagtagcacctaaattagaagaatctactaatatagcttctaaagattaccaagatgctcctgtctttacaaatggtagaatgcaaaatggtgtggctagtgatccatcaactgttgcaattagtgactcattactaaaattaaatgatggtactgctaatgatggtacaaacactgatgctagatggacaaactgggctttaagaaatgaaaatccaccagtagatacatatgtacaattagaatggaaaaatgaatatacaatgcaaaatgtaaaactttggcattttacagatagtgcatatagtgttttaccaggtgatgataatgttcgttttgaatactttgatagcgaaactaatgaatggaaagaaatagaatcttcacatataacacaaattccatatacttctggtgatacaccatatggatttgtaacaccaattactacaagtaaattaagaatttggttaaaagcaccacaagctggtaaatgtatcggtttaacagaagttgaagtatataattatgttaaacaaacagaagctaatacaactactaatcttgatgaattaaaattaaatggtactaatattgaagactttgaaggttttgatggttataatgaagaaactaaaacatatactgtaaacttaaaaacagctgattatccaactgttgaagctagtgctaaaaacaatgaatcaatcacagttttaccagtatataacgatgaagttaaaatcattgtaaaatcagaagatggtaaatctgttgcaacttatacaattaagtataataaagaaacaacagaagtagataaaactaaacttcaagaatatgtaaatagtcaagaaattactagtgctattaattcaattgataaatatactgttgagtcatatcaagtatttaaagaagcatatgataaagcaaatgaagtattagcaaatactgatgcaacacaagaagaagtaaatcaagcttatcaatcattaaaaacagcatacgaaaacttagaagaaagagtaattgaaggagatgcaaataaatttgagttatcaattgcaatagatttagctaaaacaataactgatgaagatttaaaaaatgttgtaccagtagtagtaactgaatttaaagatgcacttgctcaagctcaaatagttttagctaatccagatgcaacacaagaagaagttgatacagcctttaatcgtcttgcaaatgcaatgtggaaattagaattctacaaaggtaataaggcacaattacaagcatttgttgaacagttagctggtttaaatgaagatgactatagtcaaaaaacttggcttgtatttgaagaagcattaaataatgctaatgttgtattagctaatgaaaatgcaatgcaagaagaagtagatgaaacatatactaaattagttaaagcattcttggaattaagattaattccaaataaggatttattagctgatttaatcaatcaggcagaaagcctaaatgccaatgattatacagcagcatcttatgctaaattaaatacagcacttgtaaatgctaaaaacgtatttgcaaatgttgatgcaacaatagaagatgtaactgcagctgaaaaagcaattgaaactgcattaacagaattagtaaaaaatccatctctatcaaataatgacagtaatgtagtaaatagtggtgatactacaagtataaaaacaggagatgcaactagttttgtaagtataacaggtttaggagcttcattaagtgctcttgcatatctatttgtttctagaaagaaaaaaagtaagaaataa

SEQ ID NO: 2433 - DNA, 4227 bp, Unknown
  Artificiall/Consensus sequence
atgaagaattattttatgggaattgacgtcgggtcaactacgataaagatttatattacagatcaagatgataattgtatttattcgaaatatgaaagacattattcagatatccaggcaacaattaaaacattatttaatgaagtaaaagaaaaattcggtaatattaaagttgttgctgtgatgacaggatcaggaggtttatcactatctgaatatttaggaattaagtttgttcaagaggtaattgcttgtacaaagacaattgaaacatatattcctgaatgtgatgtagccattgaattaggtggcgaagatgctaaaattacttattttcaaggtacattagaacaaagaatgaatggtacttgtgctggtggtacaggagcgtttattgatcaaatggcttcgttattacaaacagatgcagcaggattgaatgaattggcaaaaaattatcagatgatttatcctattgcttcacgttgtggagtatttgcaaaaactgatgttcagcctttaattaatgaaggtgctaataaagaagatatagctatttctattttccaagcagttattaatcaaacaattagtggattagcttgtggtaagccaattcgtggaaaagttgcatttttaggtggtccgttatatttcttggatcagttaagaaaacgttttattgaaactttgaatcttaaagatgatgaagttatttttccggataattctcaattgtttgttgcgatgggggcaacattgttagctaaagaagaagataaggttagtgatattgatggtctattagagagattggataatcttgatgatagtatgataagccatgaaaatacgttggaacctttatttgaagatgatgtagatagaaataaatttataaatcgtcattatatagataaagttagaaaaaatgatattaatggttatattggtaatgtatatttaggacttgatgttggatcaacaacaactaaagcagtattaattgatgaaaatgattctttattatattcattttataattctaatgaaggaagtccattagatgttgttgttaagattatcaaagaggtatatgatcttttaccacctcatgttaacttggcatatagtggagttactggttatggtgaggccttgattaaagcagcttttaaagttgatatgagtgaagttgaaacaatggctcattataaagcagcaacttattttaaagaagatgtaagttttatcttggatattggcggtcaagatatgaaagcaatcaagataaaagatggtgtaatccaagacatcttattaaatgaagcttgttctagtgggtgtgggtcttttattgaaacatttgcaaagtctttaggttatgaggtaagtgagtttgctaatatggctttaaattctaaagcgccaattgatttgggtagccgttgtacagtttttatgaactcaaaagttaaacaagctcaaaaagaaggagctaaaattgaagatattagtgcaggtttatcttattcagttattaaaaatgcattgtataaagttattaaattaagaagtaaagatgaacttggtgaaaatattttagttcagggtggtactttttataatgaagcagttttaagagcttttgaaaaagaagcaggtgttaatgcgattagaccagatatcgcaggattaatgggagcatttggaattgcacgattagcaagagaaagttatcaaggacaaccaacgacattattaagcaaagaagaattagataaatttagttgtcatagtgaaattagatattgtcaaaaatgtactaatcattgtatgttgacggtttcaatttttaatgatggtagtgaatttatcagcggtaatcgttgtgaacgtggggctaatattcctgtaccaagtaagaaattaccaaatttatttgattataaatatcgccgtgtatttaattatcgttctttatctcaagaacaggcaagtagaggaactgtaggaattcctagagtattgaatatgtatgaaaattatccattctggcatactttctttactaaattaggatttagagttgttttgtcgccacgttctagtaaaagtatttatgaaaaagggatagaatcaattccatctgaaagtgtatgttatccagctaaattgtcacatggacatattgaagcattaattgaaaaagggattaaatatatcttttatcctagcttagcttatgaacgtaaggaatttgataatgctaataaccattataattgtccagttgttacatcatatcctgaagttattcgtaataacgtcgataatttagatgataattcaattatatatcgtaatccgtttatagatttaagtaatcctaagacactatttagtaatttaaaagatgaattagaagcatttaatattagtgataatgatttaaagcaagcaattgatgctgggtatgatgaattatcaaaatgccgtaaagatattcaagaacaaggagaacttgttttaaaatatattaaagaaaataatatgacgggcattgttctagctggtcgtccatatcatgttgatccagaaattaatcatggtctagcagatttaattacagctgaaggtatggcggtattaactgaagatagtatttgtcatttagataaagatttggatcaattaagggtagttgatcaatggacatatcattctaggttatatcgtgcagcatcatatgtagcttcaaaatcaaatcttgagttgattcaattaacttcttttggttgtgggttagacgctgtaacaagtgatcaagtagctgaaattttaaatgcacgtggtaaaatttatactttgattaaaattgatgaaggtagtaatttaggtgcaattcgtatacgaattcgttcactaaaagcaacaattgaaaaacaagccaaaaataaaaaactaatttatccaaaatatcaaccattaaaagtaccatttactaaaaaaatgaaagaagaagggtatacaattctttgtccacaaatgtctccaattcatttccaatttgtagaaacagcaatgcaagaatcaggttataatttagttgtattaccatctgttgataaaggagcagtagatgcgggattaaaatatgtaaataatgatgcatgttatccaagtattttagttacgggtcagataatggaagctttattaagtggtaaatatgatttagaaaaaacggcagttattatttcacaaactggtggagggtgtcgtgcaactaactatattgcatttattagaaaagcattacaagatgctggcttgtcacaaattccggtaatatcagcaaatttacaagggcttgaaaataatccaggatttaaattaactttaccattagtgaaaaaagtaattattggagcaatgtatggtgatttgtttatgagagttttatatcgagttagaccatatgaggcggtaaaaggaagtgctaatgaattatatgaatcatgggttaaacgttgtcacgaaaatgttaaaactggaagtatttctacttttagaaagaatgtttaccaaatcgtaaaagaatttgatgaattatcattattggatataaagaaaccacgtgttggattagttggggagatattggttaaattccatccaacagcaaataatgaaattgttgatataattgaacgagaaggtggagaggcagtaatgcctgatttgattgatttctttcaatattgtttctatagcactgattttgaaaataaacattttcatgcttcaaaaaatgcagttagactttgtaatttagcagttaaatttgttgatttattacgttatgatatgtctaaagcattaaagaaatctaaacgttttgacccacctgctaaaattgaacatttagctaataaagctagtacaattgtatcaattggaaatcaaactggtgaaggttggtttttaactggtgaaatgattgaattgattgaatctggagcaccaaatattgtttgtatgcagccgtttggttgcttgccaaatcatgttactggaaaaggggcaattaaagctctacgtaaggcttatcctgaaagtaatattgttgcaattgattatgatcctggagctagtgaagttaatcagttaaatcgtattaagttgatgttgtctacagcatttaaaaatatgaataaaaaataa

SEQ ID NO: 2434 - DNA, 2463 bp, Unknown
  Artificiall/Consensus sequence
atggaagaacgtggaattagaaaagttaaattaacatctgaaatgaaaaactcttttatgcaatatgcaatgtcagttattgttgctagagcattacctgatgttcgtgatggtttaaaaccagtacaaagaagaattatttacggtatgagtgatttagggtgtacaccaggaactccgtataaaaaatcagcacgtattgtcggagaagtaatggggaaatatcatcctcatggggattcttcaatttatgaagcattagtaagaatggctcaagatttttcttatcgatatatgttagttgatggtcatggaaattttggttcaattgatggcgatggtgctgcagcgcaacgttatactgaggctagaatgtctaaaatttctagtgaattagttagagatttaaaagaggatacgattgattttattcctaattatgatggtgaagagcaagaaccatctgtactgcctgctagaattcctaatttattaattaatggttcaactggaattgcagtagggatggcaactaatattccaccacataatttaggagaagtaatagatgcaattcttgcagtagctaaaaatcctgatatttcaatagttgaattaatggaaaattatattcaaggtcctgattttccaactggtggatatattttaggtaagagtgcgattaaaaaagcttatgagacaggaaatggtttaattgtcatgagagctaagactgagatagaagaaaaaggtaataaaaaagtaattattgttacagaacttccttatatggttaataaagctcgaatgattgaaaagatgtctcaattagtcagagataaaaaaattgaaggaattacagaaatccgtgatgaatcaaatcgtgatggtattagagttgtaattgaattaagaagagatattcaaccagaagtaattttaaatcaattatataaacttacatcattgcaaactacttttggtgcaaattgtattgcattagtaaacaatgaaccaaaaacattaaatttaaaagaaatgataagtttatatcttgaacatcaagaagaagttattagacgtagaactaaatttagattaaataaagctgaagatcgtgctcatattttagaaggtttaaaaagagcattagatcaaattgatgccataattgaattaattcgttcaagtcgtactactgatattattcaaactagattaatggaagaatttaatatgtctgataaacaagctaaggcaattcgtgaaatgcaattgcaacgtttagctggtttggaaagacaaaaaattgaagatgatttaaataagttattagaaattattgcggatttaaaagatatattagaaaatagagaacgtttattatcaattattcatgatgaattagaagaaatcaaagataaatatggcgataaacgtcgaactgaaataattcaaggaacatttgatttagaagatgaggatttaattccagttgaagatgttattatttcccttacaaataatggttatataaaaagaatgcctgtagatacatataagtcacaaaatcgtggtgggcgtggtattaaaggtatgtcaacaaataatgatgatatagttagttcattaataaatatgtcaactcatgatgatttgttgttctttactaattttggaaaagtttatcgcttaaaaggatataatattccagaatttggacgttctgctaaaggattgccagttgttaatttattggatcttgataaagaagaaagtattaaatcaatgattaatattgatcgaaaacaaattgaacaaaatagtaattattatttattctttgttactaaagatggactagtaaaacgtgttcacatcaatgaattccaacgaatccgtcagtctggaaagattgcaatttgtctaaaagataacgatcagcttgttcaagttaaacttacaagtggtaatgatcaaatattaattgcagcatcaaatggtaaacttgttcgttttgaagaaagtaatgttcgtccaatgggacgtatttcaagtggtgtaaaaggtattaatgttgatggtagtgaagttgtaggaatgacaactgataaagaaggaaaatatattttagttgttactgaaaggggatatggaaagatgtctccattagaagaatatcgtttatctaatcgtggtggtaaaggagttaaaacaattcatactactgaacgtaatggaaaaattgtggcattacgtgcagtaaatggtgatgaagatttattgattataactgatgatggtattatgattcgtttacctatggaacaagttacaactgctggtcgtgctactcaaggagtacgtttgattaaagttaatgaaaataataaagtttcatctgttgaagtagttgaaaaagctgttgaacaagatgatattgatgatgaaactacaaaataa

SEQ ID NO: 2435 - DNA, 2706 bp, Unknown
  Artificiall/Consensus sequence
atgacaaataagcctataaaaacaaaatcaaaaacgaaattgaattggaaaaaaatatttacaagtttaggaattgtaatgattgttttgtgtcttgctggtggatcattttttgcatggactatctataaagaaacagaagatttttcagcaaaaaaattactttcagaagaacctagtaaaatatacgatgataaaggtgaattaatgtatacatatggaagtgatgttaatggtaaacgtgaaaacatcacttatgaagatttaccacaagtattaattgatgctgttgttgcagcagaagattcaagattttttgagcatgacggtttcgatttaccacgtatcgctaaaacactgattacaaatttagcacacttaagtattcgtggtggtggttcaacaattactcaacaagtaataaaaaaatcttattttcctaaagaagagcaaacatatactcgtaaaataagtgaaatatttttagctattcaagctacaaaagaagtaagtaaagaagaaattcttactctgtatttaaataaaatttattttggacgtagtactaattcaatcggtattgctgctgctagtaaatattattttaataaagaagtatcacagcttacattaccagaagctgcactattagctggtaccttgaattcaccaagtgcttatgatccatattataatttagatttagcaacaaaacgtcgtgatattattttaaatttaatggttgatcatggatatattactcaaaaagaatgtgatttagctaaacaagttaaaattgaaaatatgttatgccgtggaacttcaacttctgatgattctttagctgcatatgttgatttagttaccaaagaagttaaagaaaaaactggattagatccaactgaaactcaaatggaaatctacacatattgcaatcaggaattacaaaaaagagcaactgccatggcaaatggtgaaacatataaatatagtgatgaagatatgcaaatgggtggaagtgttcaatctacacaagatggtcgtattgttgcagtaattggtggccataattataaatctggagacttaaataaagctacagtaaaacaacaacctggttcttcaattaaaccaattcttgattatggaatggcctataaatacttagattggtgtactggtcatacagtaaaagatgaaccaattgaggctggaattaaaaactgggataatcaattccatggttcaatgacaatttcagaagctttagaaaattcttggaatattcctgcttatactactttccaagaagtaaaaaaagttgctggttctaaaaatcttactgaagaccttgaatcattaggaatagacatgtctgatcaagatcctgatttacctgattcttatgcaattggtggttggagtactggtgtaagtccagtagaaatggctggagcttatgcaacagtagcaaataatggtaaatatattgaatcacatactgtaaattatattgaagttgcaaaagacaatgaaacaattaaagtagacgaacagttacaaaaaaaggctactaatagtattggtgaagatgtttctttcatgattcgtgaaacaatgttaagctatactagtaatggttcaggaagttatgcatatttaaatggtattgataacattggtgctaaaaccggtacttctaactgggatagtaaaagtagctatgtaaaagctggaaaaagccgtgatttatggatgacaggatatacacctgattacacttgttcagtctggatgggatttgatactgaaggaattaaaaaaggaaaaaatacttctgattataaagcttatccaggtcgcgttgtaggtgaattacttgagtatttagaagacactacaactgataaaaaatcatatcctaaacaacctgacagtgttgaaaaaatagaaattgtagctggtgtttacccatacgttagccctaattcaaatacaccaagtgataaaatcatcactgcatgggctaaaaaagggactggacctgctaattcttctaattcatcatctgaagaagaatatgatattaatagtttatcatcatttaatgcttcactttcaagtaatggaaaaattcatgttgaattttctcaatacgaaccagcaaatgctgctactgatgaaaatgcaaatgaagcaactaaattatatggtgtagttgaatacgttgttgaagtgactaatcctaatactaatgaaatcttatattcaacaactcttaatacccctactggtacaataaattatactccttccaatagagttaatgttactggatattatcgttttcaaaaagctcatgaaaaagtttctaacaaaattactaaatcagttggtactgataaattagatgatacgattgattattccatcacttccaatggttcatcagttagtaatggaagtacaattacaagtaacttgattacaataaaagtaaatgcacaaaatagttcaaatactattagtattgatttttatacaagtgatggtaatgcatatggagattcaattgtctttacaggtagtggttctagagaaattgaattaacaccaggtcagtatacgattagaatttctgaatctaatgattctagaacagttactaatacaattacatttacaattgaaagttcaaataactaa

SEQ ID NO: 2436 - DNA, 4809 bp, Unknown
  Artificiall/Consensus sequence
atgaaaagattaaagaaatgtctaagtttgatacttgcaatagctgtatgtatgtcgacgttttttgcttcgactacaagtttagaagttatggctgcaagtgaaaatgaaattggaaattacactgattttaataacagtgatgatggaaatgttattatctttaatgtagataatgcccaagtgaaagttgaattatgtacagcaagaacgctcagagttcaattgtcattaaatggtaatgatggatatcgtcctgaagacccacaatactatatggtacaaaaaaatgaatggccattagtaaataaaacaattgaagataaaggggactatattcaaattttaactgatcaaattgaaattagagtacaaaaaaatccatttagaatcggaatgtatgatttagatggaaatttaattagtaaagactctgatgatcaagggatgtactggaatgatttaggagttagaggagttaaaaagactgaaggtagtacaaatgctggggggatttttggatttggttcaggtgatcatggtagaagaagtaatttaaatcgttatgatcaagatttttctgaattttctatgtctcatggtcgagttatagctccatttttcatgagtacagtaggatatggtattttcttaaatacaattgaaaaagatactgcattctataaacatggtggaggattccaaactaaaaattatttagattattattttatgtatggacctgattttaaaactattttaaatgagtatgctgaaattactggtagaatggaattatatggaaaatgggctcatggtttcatgttatctaaatatggtaatgataatgcgactcaagcagaatttttagaatggattcatcgtttaagagacgaagattatccagctgactgttatgtttttgactatggatggcgcggtgacgttgctgataatgggggaaatcaaacaggtgccggtcaaaaatggggaaaacaaatgtggaacaatgataagacaaagttcccagatatcgatgcaatgtttaaagaagccgatgcacttggctttagagtaggtttacataacaacgcaggaacacctgaagcttctgggggagctgaattatacaaaccagaaaatgaagcaagatgggtaaaatcttacatggatagcgttattacaactggatatggtgattggttctggccagatgaatttgatgtattaggaagcaatacagctccaacattctcatctaaaggtgcttatgaagcatggcaagaatataccgatcaaagtcgtccaatgtttataactcgtggaagttatgctggacaacattatgcaactgcatggtctggcgatattaatccaacttcacaggaattgactaatcaaattggatttagtattgattctggtttaattggatattgggcaagttcacatgatttaggtggattcatgaaacgcccaagtgatgaattatatacacgctgggtatctgaatttggagcatggaatggaattatgcgtactcacggtcatgatggacgtgaaccatggacttacagtgaaacagctcaagaaactttaagagaaaatttaaagattcgttatgcattatatccatatacatactctttagcatggcaaggatatagtcaaggtgtaccaatcatgcgtgcaatgctacttgaagatgatagccaatataatccagatgcatgggatttaaatgaacaatattattatggtgattatttcttagtagcacctgctgctgatactaaagatacagttgtttcagtttggttaccacctaaaacaacatggtataattattatacaggtgaacgctatgaaggtggcgaaaatggaaaaacaattagagtagctgctaaattggatgaaattccagtatttgtcaaagctggagcaattattccaatgggacctgaagttgactacgctgatgaaaaaccattagatccacttacattagatatttatgctaaaggtgaaagtagctttacattatatgaagatgatggtcaaactcgtgaatatattacccaaaatgcttacactactacaacatatgattgtatagaaaatggtagtgaaattgattttaaaatcaatgaacgagtaaatggaaatgcagatgtatatacacctgtagatagatcttacaatttaaaattcaatcatattgaatcattaggaaatgttactattaacggtagtgatattagtcgtgttaattcattagatgagtataatgcaactacagaagcatattggttagatagtgaaaataacattgtatatgtaaaaactaaagatactggtaaagaaatcaatgttaaattattagaagttgtacaaaaagaacctgaattaggtgaagaagatgaaagtcttccaccacaagaaattaatgatggtgatgtttatgaattagaagatgcaactttattaccagtaagtggtgatagtcttactgttgatactgaatggaaaggttatacaggaacaggatttgctaaaggatttaaagcagaaggggatgcacttgaatttactgttgatgtacaacaagcaggagattacaatctagttttaaatgttaacaatggaaagaaaaatgatcctaaatatgataatagtccacgtcaaggtacaatgtatctaaatggtcaaaaattaaaggattttgaatttgaagtaactgaaaaatggggcgaaacagtcaatggcgtaaaacaaggggtatggaagaaatatacaattgaaaatgtgtcaatgagtgaaggtgtcaatacatttaaatttgttgctgaaggtgataggaatccaggaaattataatttagattcacttacatttaataaaatcgatcgttctgttgatgcatttagtcaaatcgaagctgaaaatgcaaatagttatgaagggtttgaaatcactgaagatcaagtagctagtggtgaaaaagtactttctactactactgatggtgcatggtttggatttaatgaagttaaaggtgaaaataaaggtggaataaaaattcgcttaaagagcagtactggtggaaaacttacagtatatgaaagtggtgtcggtgataagattttagctacaatggatatcccagctaatgatgaatggactacttatgaaatatcatcaaaagatacagacgttactgtaagtccaatttacttagaatttactgctttagaaaatagcgattttaaatgtgatgttgattggttcaatttcgtaccaaaattaccagaaattaatccaggtgatatctttgaattagaagatggagaaggtatcacagattcagcaaataaccgtttaagagtagatacagaatggaaaggatattctggtagcggatatgtagcaggatggaaagatgtaggaaactacgttgaatttactgtggatattaaagaagctggaacttataacttagtagtaaacgctggatgcggtaaaaaaggttcatctatatatgatgacactccaagaactggagcattatatattaacgatgaaaaagaaaatgattttgaaattcaagtaactcctacatggggtgacagtaataaaaatggtgattggaacgaagttacaattgcaaatgttgaattagaggctggtaaaaatacgattaaaattcgtagcgaaggtgatgtaaacccaggaaacttcaatcttgattacgtgcgctttgataaagtaacaacatatcaaataaatgcaacaagtaatgatgaaacaatgggaactgtaacaatcacacctgaaaaagatagttatgtacaaggtgatgaagtaacattaactgctaaaccaaatgaaagatacgaatttgtaaactggacattaaatggtgaagtagttagcatggatgcagaatataaattcactgtatcatctgatgcaaattatgtagctaattttaaaaaagtggttgttgatagtgataaaacagcattaaagattgcaattgatctagcaaatgcaattactgatgaagatttagctaatgttgtacaagcagtagttgatgaattcattgcggctagagatgaagctaatgcaatttacaatgatacaagtgcaacacaggcagaagtaaacgcagcatttgatcgtcttgcaagtgcaatgcatatgttagactttaaacaaggagataaaacagcattaaaagcatttatcgataaagttagtggattagattcaagtaaatattcaacagatacatgggcaacatttgaaacagaattaaatgaagcaaatgctgtatacaacgatgaaaatgcaatgcaaccagaagtaaacagtgcatatgaagaattagtaaaagcattcttgaacttaagattaattccagataagagtttattagaagagttgatcaatcaagcagaaggattggacagtgcaaactatacaaaagcatcatatgctgtagtagaaaatgctttattaacagcaaaagcagtatatgaaaatccaaatgcaacacaagaagaagtaaatagtgcaaaagatgtattagaaaaagcaatcaatagcttagaagcaaatacaacaacatcagtagataacacagcaagtacaccgattgataatactgtaaaaacaccagtaaataatggtgatacaactgcaagtgtaaaaacaggtgatcaagcactagtagaaacattagtaggaattacattattatctgttgcaggatttgcaatacttagaaaaaaagaaaaagattaa

SEQ ID NO: 2437 - DNA, 3762 bp, Unknown
  Artificiall/Consensus sequence
atgagtgatgtaaaacgtatatacgttgaaaaaagaacagcgtatgcaacagaagcaaatgaaattaaacataatttaattgaacagttgggattagaaatcaaaacattaagagttatcaaccgttatgatgttcaagggataagtgatgatattttaaataaaggcattgatacaattttatctgaaccaatggttgatgatgtttatcaagaagatttccctaaaaatgaagaagaagcaatctttgctattgagtttttaccaggtcaatatgatcaaagagcagattcttgtgagcaatgttttgctattttaactggtaatactaatgctaaagtaaaatgtgctcgtgtatttgcaattacttttgctggtaataaagatgatgttttaaataaaattcaaggttttttaattaatccggtagatcaacgcctagcgtctttagataaaccaaaaaatttaaatgatgaagtgccagaaattaaacctgtatctacaatcactggttttaatgagtttagtaaagaagaacttgaaaaattcttagttgataatggaatggcaatgaattatgatgatttaaaagttacacaagattactttaaaaatgaagaaaaacgtgatcctactgaaactgaattaaaagtattagatacatattggtcagatcattgtcgtcatactacttttgccactgttattactgatttagatattgaaaatggtgcttttaaagaaattttagaaaaagatattgaaaattacaaaactagtcgtcatttagtttatggaattgatactaaacgtccacttacattaatggatttagcgactatttcaatgaaagaattacgtaaaacaggttacctagatgatttagaagtttctgaagaaattaatgcttgttcagtagaaattacagttcatacaactgatggtgatgaacaatggttattgatgtttaaaaatgaaacacataatcatccaacagaaatagaaccatttggtggagcagcaacttgtttaggtggagcaattcgtgatccattatcaggaagagcttatgtatatcaaagtatgcgtattactggagcaggagatccacgtaaatcattagaagaaacaattaaaggtaaattacctcaacgtaagatttgtcaagaatcagctcatggtttttcttcttatggtaaccaaattggtttaacaactggttatgttcatgaaatttatgatgaaggttatgtagctaaaagaatggaattaggtgcagtcgtggctgctgctccaaaagaacaagttaaacgtttagaaccattaaaaggacatgttgtcttattaattggtggtcgtactggacgtgatggaattggtggagctactggttcttctaaatctcatgatattaagtcaattgaaacagcaggtgctgaagttcaaaaaggtaatccagttgaagaaagaaaaattcaacgtttatttaggaataaagaagtaagtgaaaaaattgttcgttgtaatgattttggagcaggtggagtctgcgttgctgttggtgaattagcacctggtctagaaattgatttagatgccgtcttaaagaaatatgatggtttaacagggacagagttagcaatttctgaatcacaagaacgtatggcaattgtagtagatagtaaagatgttgattttattaaagctgaatgtgctaaggaaaacttagaggttgttcaagttgctattgttactgatcaaaatcgtttgataatgagacatatgggtaaagatattgttaatatttcacgtgagttcttagatgcagctggagcaaaacgttatcaagatgttaaaattatgttacctgattttgaaaacacaccatttgataaacaaccacaaactagttttgttgatactgtaactaagacattatctaaattaagtgttgcttctcaaaaagggttaattgaaagatttgattcttcaattggtaatggtacagtgttatcaccttttggaggaattaaatatcatagtgaaactgaagggatggcagcattgattccagtgctaggaaaagaaacaacaacagcttcaatcatgacttatggatataatccagtaatctctaaatggtcaccataccatggttcaatttatgcaattgttgaatcaattgcgaaaattgttgcaatgggtggaaattatcataatattcgtttttcattccaagagtattttgaaaaattattaacaaatccaactacttggggtaaacctacagcagcattacttggtgcttatcgtgttcaaaatgctttaaaattaccttcaattggaggtaaagatagtatgtcagggtcatttgaggatttacatgtacctccaacactagtatcttttgcaattactagtagtgatgttgatgatattatgacacctgaaattaaagaagcagggcatatattagtagaagttgttattaataaagataaatatcatgtatttgattttgatcatttacaaaaacaatatgatgctattatggcattaatgaaagaaaataaaatttatagtgcatatactgtaaaagatggtggtgtaattgaagccgttagtaagatggcttttggtaatggtattggagttgcttttagtggtgaatatgatttagatagttatgtaatgcgtgattatggaaatatcatcattgaagttaaaaatgaagaagatttagatgtttttgataattatcgtattgttggtactactaatgatagtgaagtattatcatatggacatgaagctatttctttggatgaagcatatgcaattaataaggcaccattagaaagtgtctatccaacaagagaagtagcacctacaagtgaaattaaagtagctgcatgtaatacacgttctactttaaaagcaaaagttactgttgaaacaccacttgtagttattccggtattcccaggaactaactgtgaatatgattcaaaacgtgcttttgaaaaagctggagcaaaagttcaattagttttaattagaaataaaactgaacaaatgcttacagattcaattaatgaattagaagcagcaattagacaagctaatattgtaatgttaccaggagggtttagtgctggtgatgaacctgaaggttctggtaaatttattgccacagtattaaagaatcctcgtttaaaagatgcaattagtgatttattggataatcgtgatggattaatgattggaatttgtaatggattccaggcattaattaagttaggattattaccatatggtaaaattcaagatatgtctaaagatgatccaacattaactttcaatacaattggtcgccacgtttcacaaatggtagatacaagaattggaagtgttaaatcaccttggttaaaatatgtaaatgttgatgatattcatacaattccagttagtcatggtgaaggtcgttttgtagcgccaaaagaagttattgaagaattgtttgaaaatggacaagtattctctcaatatgttgaccctaatcgtaaggtaacaatgcaaacaccttataacccaaatggttcaatgtatgcgattgaaggaattatttctcgtgatggtcgtgttattggtaaaatgggtcatagtgaacgtcaaggtgaaaaccgctttaaaaatgtttatggtgaaatggatcaaaaattatttgaagcaggtgtagattattttaaaggtggaaaatag

SEQ ID NO: 2438 - DNA, 3519 bp, Unknown
  Artificiall/Consensus sequence
atggctaaaaagtatttatcaatggatggtaatacggctgctgctcatgtggcatatgcatttacagaagtagcgagtatctatccaattacaccttcatctccaatggctgaaaatgctgaagcgtgggctgctcaaggaaagaaaaatatctttggctcacctgttaaagtgattgaaatgcaatcagaagccggagctgcaggtgctgtccatggggctttacaaggtggtgctttggcaacgacttttacagcatctcaaggattattattgatgattcctaatttatacaagattgcaggggaattattaccgggagttttccatgtatctgctcgtgcgcttgcaactagatcattaaatatttttggagatcatcaagatatttatgcatgtcgtcaagtaggaatgccgatgatttgttctcattctgttcaagaagtaatggatttaggaggaattgcacatttaactgcaattaaaggttctgttcctgtaatgcatttctttgatggatttagaacatcacatgaaattcaaaaagttgaagtaatggattatgatgtacttgcaagtcttttagaccgtgaagcacttgcaaaatacaaaaaacatgctttaaatccacacactaatccagtagaacgtggtggagcagaaaatgatgatatttacttccaaggacgtgaagcgcaaaataaacattatgatgcggtagttgaaattgttgctgattatatgaaaaagatttcagaaattactggtagacattatgcaccatttacatattatggtgattctaatgcaactagagtaattatcgcaatgggatctgttacagaaacaattaaagaaactattgatgaattaaataatcaaggtgaacatgtaggattaattaaagtacatttatatcgcccattttcaccaaaatatttattagatgtattacctgaaagtgttgaaaaagttgctgtattagatcgaacaaaagaaatgggagcaactggtgaaccattatatttggatgtttgcagtgtattaaaagatgtagatcatgttaaaactatcgtaggtggacgttatggtatgggatctaaagatactacacctcgtcaaattaaagctgtttatgatcatttattgttagatgatccatttacttcatttacaattggtattaatgatgatgtaactaatttatcattaaaagaagatccggattttaacgtaaaagctgattatactgcatgcttattctatggtttaggttcagatggtactgtttcagcaaataaatcatcaattaaaattatcggagatcatactgatttatattcacaagcttattttgcttatgatagtaaaaaagctgggggagctactcgttctaatttaagatttggacatagtccaattagagcaacttattatgtaaataatgctgattttatttcttgttcattagataattattgtttaaaatatgatatgttaaagaacttgaaaaaaggtggtattttcttattaaatactgaatttaatgaagatgaaatcgttgagtatttaccaaacaaggtaaagaaacaattagcagacttagaagctaagttctatattattaatgcaaataaaattgctaatgaaattggtatgggtagaagaacaaatacaattcttcaatcagcattctttgctttgaatccacaaatcttaccaattgatgaagcaattaaatatatgaaagaaatggctaaaaaaacttatggtaaaaaaggtgatgccattgttgaattgaattataaagctattgatgcaggtaaagatgctattattgaagttaaggtggatccaagttggtctgatttaactgtaactagtcgacgtgtaagaactggtgatgatcattttgataatttcgtatcaattattaataaattagatggctatgatttaccagtttctgcatttatggataaattagatggttcaatgcaatctggagtagcaataaaagaaaaacgtgcaattgctactgaagtacctcgttggattaaagaaaactgtattcaatgtaataactgtgttatggtttgtccacatgcaacagttagagcattcttaattgatgatgaagaaatggctgatttaccagaagatattagcgatgatgttttaaaacctatcggtaaaaatgttgatggattggtttatcgtatccaagtgtcacctgataactgtgttggatgtggtttatgtgtaactgaatgtccaggtaaaaaaggtgaaaaagctcttgaaatggtaccggtaaaagaagagttaaaacacgctaaattagctgatcatatgtaccaacatgttgaatataagactgataaatatccattaactacagttaaaggtgtaggatttatgagaccttattttgaagtgtctggagcttgtggtggatgtggtgaaacaccatactatcgcttggcgtctcaattatttggtaaagatatgatgattgctaatgcaacaggatgtagttctatttatactggttctactccatcgacaccatgtaatattgataaaaatggacaaggtccagcatgggctaactcattatttgaagataatgcagaatatggttttggtatgaaattagctgaaaattataaaacaaatcatttattaagtgtaattgaagctaataagagtgattgtgaaccagaattacaatcattattagatgaatatgttgctagcaaaggaaatcgtgaacaagaaagaacaattgttgataaaatgttaccattaattgttgcttctaaaaatgaaggaataaaagaattattagatcaagaaggagatttggtaagtaaatcacaatggattatcggtggcgatggttgggcatacgacatcggttatggtggtgttgatcatgtattagctagtgatcaaaatgttaatatcttagtattggatactgaagtatattctaatactggaggacaatcttctaaatcatcacaagcaggttcaatagctaaatttactgctggaggtaaaactgtagctaaaaaagatcttgctcaaattgcaatggcatatggacatgtatatgtagctcaagtagctatgggtgctaatcctatgcaaacaataaaagcatttaaagaagcagaagcatataatggaccatcattaattattgcttactctccatgtatggaacatggtattaaaggtggtttagcaaatcatcaaaaacaacaaaaagatgcagtagcatgtggatactttaatttattaagatatgatccacgtttagaagatgaaggaaagaatccattacaaattgattcaaaagaaccggattttgataaatttaaagatttcttattaagtgaaaatcgttttgcacaattatcaaaaattaatcctgaacacgctgatgaattgatggataaatgtttgaatgatgctaaaaaacgtcgtgaacgtttgaatagaatgatttaa

SEQ ID NO: 2439 - DNA, 3675 bp, Unknown
  Artificiall/Consensus sequence
gtggaaaacaaaataaccaaagcaaagagtaaaattaatcgtcgtaattattcaagaataagtggatctttagaacttccaaatttagtagaaattcagacaaactcatataaatggtttaaagaagtaggaattaaagaagtttttgaagatatctacccaattactaactttaatgaaactttatcgttagaatttgtagattgtgtatttgatgaagcaaaacactcagttgaagaaagtaaagatcgtgatgcaaactatgcagcacctattagagcatctttacgtttagtgaattcaacaactggtgaaataaaggaacaagaagtatttatgggagatttcccattaatgacagattctgggacttttataattaacggtgctgagcgtgttattgtatcacaattagttcgctcacctggagcatattttgcagatgcactagataaaagtggaaaaactgtattcaatggtagtattataccatcaagaggaacttggttggaatttgaaaatgatgccaaggatgttttaaacgtgcgtatcgatcgtaatagaaagatgccaggtacagtattattaagagctttaggtttatcaagtaatgatgagatcattgaagtttttggtgaacatgagtttattttaaacactttagctaaagataatacaacaaatatggaagaagctttaattgaaatttataataaattaagaccaggagaaccagcaactttagagggagcaaataacttattatttgcgaaattctttgattgcaaacgttatgatttagcaaaagctggtagatttaaatttaagaaaaaattaagtcttttagatcgtatctctggacgtgttttagctgaagacttaattgatattgacggaaatgtaatttatcctgaaggaacatatattactcaagaagttattgatgtaattaagccagtgcttgaagctggggctcatacgcgtgaaattaaaactaaccctagattagaatcaaatggtgttattcaaattttagatgtgtatgttgatgatacaaaaagtaaaaaaatgcgtgtaattggtactgatttatcattagatagtaagtttgtaactatttctgatatgattgcagcatattcttatatgttcaatcttgtagatatttataattctttagatttaacagcagaagatcgtgttaattttatgtcacgtattggtttgttggatgatattgatcatttaggaaatagacgtgtacgttctgttggtgaattgattcaaaatcaatttagaattggtttatcaagaatggaaagagttgttaaggaaagaatgtctttatcggaagtggattcaattactccacaatcattaactaacattcgtccattaacagctgcaattaaagagttcttttcatcatctcaattgtcacagtttatggatcaaatcaatcctcttgcggagttaactaataagcgtcgtttgtctgcattaggacctggtggtctaagtcgtgaccgtgcaggttatgaggtacgtgatgtccatgcatctcactatggtagaatttgtccgattgaaacacctgaaggaccaaacattggcttgattacaacattagcttcatatgctaaaattaatgaatatggatttattgaaacaccatatcgtaaagtaaataattgtataattgatgaaaatgatgttcgttatttaacagctgatgaagaaaagaattatattattgctcaatcaaatgtaaaaactgatgaaaatggaactatattggatgaacaagttattgctcgtcatttgggtgaaaatatcatggcaaaacgtgaagaaattgattttatcgatatttcgccaaaacaaattgtttctgtggctacttcatgtattccgttccttgaaaatgatgatgctactcgtgcgttaatgggagcaaacatgcaacgtcaagcagtacctttattaaatccacacactccatttgtaggaacaggaatggaacatcaggctgcacgtgattctggggctgcagttgttgcaagagaagatggaattgtaaaatatgttgatgctaaaaagattattattgaagataatgagggtgttgaacatcgatatcgtttagcaaaatttaaaatttcaaatgcaggtacatgtattaatcaaaaaccaattgtaaaagatggagaagcagtattaaaaggacaagttatcgctgatggtccagcaatggaacaaggtgagttggcattaggacaaaatgttttagttggtttcatggaatggaatggatataactatgaagatgctgtaattatgtctgaaagattggttaaagaagatgtgtatacttcaattcatattgatgaatatgcaattgaatgccgagatacaaaacttggacctgaagaaattactcgtgatatccctaacgttggtgatgatgctcgtaaaaatttaaatagtgatggtattatcatgattggtgctgaggtaaaagaaggagatattttggttggtaaggttaccccaaaaggtcaagcagaactttcagcggaagaaaaattgttgttggcaatttttggtgaaaaatcacgtgaagttaaggataattcattaagagtaccacatggtggggctggaattgttcatgatattaaagtgtttgaaagaaaaaatggtgatgaattacaaccaggtgtaaataaagttgtaaaagtatatattgtgcaaaaaagaaaaatctctgaaggggataaaatggcaggtcgtcatggtaataaaggggttatttctaaaattttaccaattgaagatatgccacatttggaagatggaacacctttggatatcatgttgaatccattaggggtaccttctcgtatgaacattggacaagtacttgaattgcatttaggatatgcagctcgtcaattaggtttatacattgcaacgccagcatttgatggtttacatccaagtgatttagaagatattatggcagaggcaggaatgtctaaagatggaaaacaaccagtaatttctggacgtactggagaatattttgataataacatctctgtaggaattatgtatatgatcaaattagcgcacatggttgacgataagttacatgcccgttcagttggaccatattcattagtaactcaacaaccattgggtggtaaagctcaaaatggtggacaaagatttggagaaatggaagtttgggctcttgaagcatatggggcagcatatacattacgtgaaattttaactgttaaatcagatgatgtagttggacgtgttaagacatatgaagcgattgttaaaggacaaccattacctgaaccaggattacctgaatcatttagagtattaaagaaagagttacaagcacttgcattggatgtacgtttgttagatgaaaatgataatgaagttgatatgcgtaatattgaagaagaggaacatcgtttcccgcgtagtattgataaagatgaagtaattgaaactccaaaaactgatgatgaagtttccgaagaaattactgaagatgatttaaatgtagaagaatgtgacgtatgtgaagaagataactttgaggacaatgacttcgaagacaatgatattgaagaaagtgaatcattatag

SEQ ID NO: 2440 - DNA, 2091 bp, Unknown
  Artificiall/Consensus sequence
gagggctgtaaaatggaaatgactagattattagaagattatggatgtttaacatttagtgatgatgtaatgaaggaacgaattccaaaatctatttataaagagtttcatgcatctttagataagggagaagaattatcaaaagaatgtgcaacagtaattgctaatgcgatgaaaatatgggcattagaaaatggagcaacacattttactcattggtttatgccaatgactggattaacagcagaaaaacatgatgcatttattgaaccggatggttctaaagcagtattagaatttagtggaaagactttaagaaaaggagagcctgatgcttcatcttttccatccggaggcttaagagcaacatttgaagctagaggatatactgcatgggattgtacttcgccagcatttgtaaaggatagcagtttatatataccaactttattttgttcatatacaggtgaggcactggataaaaaaacaccattattaagatcatgtgatgctttatcaaaagctgcatgtagattattaccattattaggagttgaaggtgtaacaaaagtaacagcatcagttggtgctgaacaagaatattttttagtgttagatgagtattatcagcaaagaatggatttaaaattaactggtcgtactttatttggcacaatggcgccaaaaggacaagaacttgaagatcattactttggtagtcttaaacgtaaagtagcggcgtttatgaaagatttagaccatgaattatggaggtatggaattccttcaaaaacaaagcataatgaagttgcaccagcacaacacgaagtggcttgtgtatattccaaagttaacattacaactgataacaatcatttattaatgcaaataatgcaagatattgctaaaaaacatggacttcgttgtttattgcatgaaaaaccatttgcaggtgttaatggatctggaaaacatgataattggtcggttattactaatactggtattaatttatttaatccaggaaataatccagcagaaaataaaccatttatagctgcacttgcatgtacaattagagcagttgatatgtatgctgatttaatgcgcatgagtattgcaagcgcaggaaatgatcatcgtttgggagctaatgaagcccctccagccattatttcaatgtttttaggtgaggatttggaagctcttattgatgaaatttgtgaaggtaaggaaattaaaaaagcaaatacatctcgttttgcaacaggagtatcagttgttccaactttttctaaagataatacagatcgtaatcgtacttctccttttgcctttacaggtaataaatttgagtttagaggggtcggttctagtcaatccattgctggaccaaatacagtgttaaattctatttttgcagattcaatggaagttatggctgatgaaattgatggtggtaagtcatttgaaacagtggtaaaagaatttataactaagcatcgacgtattatttttaatggtgatggttattcagcaaaatgggaagaaaaggccaaagaactaggattgcttaataataaaaatacagttgatgcattaaattgtttaaaagatcaaaagaatgttgatatgtttaaacgtttaggtgtttatagtgatattgaattaaaagctcgtcatgaaatattattagaaagttatataaaaacaattcaattagaaggattaacggctttaaagatggctaaaacccaactttatcctgcagtttgtgattatttagctaagctttcttcagaaattgtatcaattaaaaatgccgatttagatgctggattcttatttaaagatgccaataaattaactaaacaagttaaattaatgaaagaggaaatggataagttagaacaaaatattaaatttgcacaaaatttagatgataatattgaaaaacaagcaattgtttggcgtgattatgtatttacatcaatgcaatcattaagagaaataactgatatgattgaagaatcagttgatgctaaatattggccaattcctacttatgtagatttattgtttggaatttaa

SEQ ID NO: 2441 - DNA, 3834 bp, Unknown
  Artificiall/Consensus sequence
atggagataaaaatgaaagtaaaaagaaaaacaagtaaagtattgaaaagtggtttggctgcaacatttgttttttcattaattgcaaccaatccaagtcaaattttagcactttctaatgtaagtaatgctactgaaaatgtgacagcagatatttatccaaaaccacaaagcgtttcttacttgtcagatgtggggatgagtttagaaggtgaagttaatgttgtagtacatggggaacaagaaactgcaaccttaccagcattagaaaaaatcttgaaagataatgggatttcttatgttattggacaagaaattgatgaaaacaaagctaatattttagtttcttcatctaaagatcattgtgatgagtgtgctagtgaagatagtgccttaagtcaaaaagaaggttatattttaactgctagtgatgatgaaaatagtaaaggtgaaattactattgttggtgcagatgttgatggggcatattatggagttatcactcttggacaaattttagatcaaagtattgataataaatttgcagaaattgtagtaagtgattatcctgaaattgaattccgtggatttattgaaggtttttatggtattccatggactcatgaagaaagaatgagcttaatgagtgatactggtaaatataagatgaatacatatatttatgcgccaaaagatgatccttatcatagagctcaatggagagaattgtatccagaaaaagaagctgctcaaattgctgaattagcggaagctggaaagaatagtaactttaatttctgttggacaattcacccaggagatcatattaatttatatagtgaagaagatttccaagcggcattaaataaattagagcaactatatgaactgggtgttcgtcaatttggagtattatttgatgatatttctaataatcaaaatggaacagctcaagctaatttcattaatcgtatcgatgatgaatttgtaaaagtaaaaggtgatgtaaaaccgttgattacagtaggaactagatattgtgctgcttggggtccaagtatgacaggatatctaaaaccatttgttgaaacgttacatgatgatgttgaagtaatgtggactggttctggaacaatgtcaaatatttctagagatatttatgaatggccaaaacaacaaataggttctgataaagactttgcggtttggtggaactatccagtaaatgattattgtgatggtaaattattaatgggacctatgaatagtttaagtactgatctaaataatgttaattcatttttctcaaatccaatgaatcaagctgaagcttcaaaagtttctttatttagtattgcagattatacatggaatactgatgcatatgattatatggaaagttggcatcgttcaataaaagaattagttcctgaaattgcggaagaatttgaacgttttgcttcaaatattagttatttaaatgatggtattcaaatggatgaatcagcatatcttgatgaaaaagttaatgctttaaaagttgcgttaagtagtggaactaatattaaagaagcagcacaagtattgcttgaggaatttgaagttattttggctgattgtgataaattaaaagatgtaggaaatgaagcgttacagacagaaattaatccatttgttggggcttatagagaattagcaatagcaggaattaattcaatgcaagcacttattgcaattgaagatggagatagtgctttagctttagctcgcgttagtgttgctcaagaatcttatgatgcaatgagtaattatactgtaaatcgtttagaagatgcaggtgaacgtaatgttgttgttgaagtaggtacacatagtttaaaaccgattgttagaactgtaattgatacggctaatgaaaaaataggagaattattattccctcaaactgtagctgaaatgattactaatgttgatggattagaaagtaaagaagtaacagttactgatggtaatttcattcttgaaggtgttaacgcaacattaaataatggggaatatttaggggtaattttacctcaagcacgcaatgtatcacaaattagtgttacaggtgcaaatttagctgatttagatttagaatattcaattaatggattagattggcaaaaagcggaagttagtaaagataatggtatttctatgagtacaaaagtttctacaacttatgtaagattagtaaataatactaatgcgccaattgatgttactattgatgcacttcaaattaatcctatttatgctactgaagcttcagcaagtacaaatatgggaacttatcaaacatataatatttctaatattattgatagtaatagagaaactaaattttggaataatgctaatccaagtgtaggacaatacattcaaattgattttggtgcagcaatgcctttatatgatataactgcctattttgctagtggtgattatattaaaaatggtaaagtacaaatttctgttgatggtaatgaatggagagatgtaggagcactagaatatgaaaatgttggtgctaataaagtatcaagtttaaatgctaatggtaaagaagcaagatatgtaagatatgttgtaactggatcacaagatgtatgggtgcaattatttgaagtagaatataatcaaactgtaggtgatatggggaatcatgtagttaaacttactgattctaatacagatggtcttcatgctaaagtttgtgaccaagatataacaactgcttttgctccaacaggtatcgaagatggagattatttaacttatcaaatgtcacgtattaacaacgtagctgatttaatcgttgttcaagatccaaataatataagtgaagctaaagttagcgtgaaagatattaatggtacatggagagaagttggtatattagataatcaagttgttacattaccagtagatggaagaattactgaagttaaattggagtttgatagtactaaaccattaccaataatttatgaaattgttgcaactcaaagaactgcggtagaaactgacaaaacagcattaaagattgcagtagacttagcaaatgcaattactgatgaagatttagctaaattaattccagcagtagctgatgagttcaaagtagcaagagatgaagctaatgcagtatacaatgatgctagtgcttcacaagttgaagtaaataatgcatttgacagacttgcaagtgcaatgcatatgttagactttgtaaaaggagataaaacagcattaaaagcatttatcgataaagttacaggattagaagctgctaaatatacagaagctacatggacagcatttgaaacagaattaaatgaagctatagcagtatatgatgatgaaaatgcaatgcaagaagaagtaaatacagcatacagtgaattagtaacagcattcttgaacttaagattaattccagataagagcttattagaagacttaatcaatcaagcaaatggattaaacggagtaaattatacaaaagcaacatttgatggattaacaaaagcattaaatgaagcaaaagcagtatatgaaaatccaaatgcaacacaagaagaagtagacaatgcaaaagttacattagaaaaagcaattgccggattacaaatagtaacaactgataacacagtaagtacaccagtaaataatggtgatacaactgcaagtgtaaaaacaggtgatgatgttaatatgttaggaacatcagcaggattagcactattaagtattgcaggagctaaagttcttagaaaaaaagaagattaa

SEQ ID NO: 2442 - DNA, 3093 bp, Unknown
  Artificiall/Consensus sequence
atgaaaaataaattttctaaattaagaaaaattgttattgcattaataatgtttttttctatgtctctttcagcgaatattgatgtaaatgcgtgggataacagtattcctcatgagtttactcgggttaaagaaattaaatatcctgagtggtgggcacgtaaagtgccaggaataagtgcatggagtactttttcaactaaatacaatggtaaatgggcttattgtttagagtctagtaaaaatgcacctcaagatggaaattatgtagctgatgttattgaaaataatgaggcagtaagaaaactgatgtattatggttttggtggtcctgcaccttatggagaatttgcagatggttatgatttaaaaagtgcaatttgtcctgatgacagttatttgtcaaatgatgatgtaaagtatcttttaacacatatatttttaagtggtgcatatagtggtgattggaatggatttgatgaacaaaaattcaatcagatatttggtggtacttatggtagcgatataatgaatatatatcgtagaatattagaattacctgaacctgattatgtaaaatttaatcctagtagtgcagttgatggtacagaagcaacatttaacgcatcatttgatataaattcaaagcaacaaatcacaaatactataacgttagaaggaagtaataatgcaaccattaatattcctttagatgcaaatgtaactattcatatttcaggtggaggtgtacaaacaggtggtatggctactgttcatggtggccaaagtttttattttactgcgccttgcgatgggtcgccagctgatatgcctattacagaagttacaggtgataattgtgggatatttacagctctagctattagaactggttcagattcgactcaaactgaaggaagttgggtttgggatcctgatagaagtcatctatatttgcaaatagattggatggattttggtaaaatagaaattactaagacaaacacaaatcatgatttgattgatggtgctatttttaatttgaagtcaacttcttttgaaggatacagtaaagatattactgttactgatggtaagattgtcgttgattatttaccagttggtacttatgaattgaaagaaatccaagcacctgatggttacttattaaatgaaacggtttatactattacagttaataaagatcaaacgactacccaaactgttataaatgaagaacctactggttcaatagatttaacaaaagaaattaacagcgatttaactgatggcaatatcggagatgcttatttaaaagataacgaatatacattaaaagctaaagaaaagattactaataaggcaggtacagtaacttattttgaaaaagatgcagttgttgatacccaggtaactgatgaacagggtaagttaaagtttgatgatttacatgttggtaaatattatattgaagaatctaaatctaatggaacattagtattaaatcctgatgatattgatgtaagtattgattatgaagggcaaactgtttctaaaattctacgttctacaagtactgataaccgagttaacatgcaaaagatacaggtacataaattcggtgaaaaagaaagtgaatcaggaattttaaatggtttagctggtgctgagtttacattcaagctaaaaagtgaagttgataaagttggatgggataatgccaagacatatgatgtaattactaccggtaaagatggacgtgcaactactaaatatttaccttatggtacttatttggtaagagaaaccaaaacacctcaagattatatgactgcacctgattttactatatcagttacaaaagattacagtgaatatgaagatattgatcaaatcaagattattgatatcaataatcgtccatatacaacgcaattaaaacttgtaaaaaaagacttagatagcaataagacagtaactttaaatagtgcaacatttaaagttaaagcaagagaagatattgtatctaatggaaaagtgatatataaagcaggagatacaattaaacagaaaatcagtggtaaaacttatgacagttttactaccagtgctaacaatgtagttgtacctgatggttcttttgaaattgctggtgaaatgggaacagtagtattaccattacaattggatgcaggtaagtattacattgatgaaattaaaacgccaacgggatatttagcattagaaagtagagttgaatttgatattgaaaatatcagagattatgataaggatgaagatggtgatccaattttagaagtgatcattaaaaatgacaaacctgtgggtgaattgatcgttaataaatcagttgatttaaatggagaagctgatttatcattagttaatattgatgatttaagtagtattaaatttagacttacagctaaagaagatatagttgattcagctgatggcagtattatttatgtaaaagatgctactgtaggagaatataatttatcaaaggatgggaaattaacgataagtgatttaccgatgggagtttatgaattacaggaaattgctacacttgatgggttggtattagatggaactaaacatgaagttaaatttgaacaaagtgatttaactactaaagtatatacagtaacacaaaatttgataaataaacctacggaaatagaaattagtaagcaagatattacaacaaataaggagttaccaggggcacatttacgattagaagatattactactggtaatacaatgcttatagaagagtgggtatctgatttaaaaccacatataattaaaggattgattgttggtcacagatatcgtttaacagaaacaatggcaccagcagggtataaaatagcacaatctattgaatttacagtagaaaataaagaaagcgttcaaaagataataatgtatgatgaattattaccacagcctaaaacaggggattcaataaataaggaattatatatgggaatagttatgtttttaggaattggcttgagtgcttatatgtttttgaaaagaaaaagagtaattaaaatttaa

SEQ ID NO: 2443 - DNA, 4965 bp, Unknown
  Artificiall/Consensus sequence
atgaaaagaacgtttaaaaaagtattggctgctgttttaactttaacaatgacatttagttcattggtaattttacaaccagtaaatgctgaaaatgaagtgtctgaatacacaatttatccaacacctcatgaagttgtatatgatgatagtgagtttgcaatttctgatgatgttaatgttgtgtatggtgatgctattgatagttttactaaagatcatgctgtagatgttttaaatattttagaaaaaacaaatacagtaagtgatgcaattgatgaaagtaaaacaaacttgattgttgggacttataattcagatgattatgctgataaatattttaaagacaatgctttaattgatagtgaagatttattcactcatagcgattcttatattctaaatgttgataacaatgttattgcagtattaggtagagatactgatgcagctttccacggaataacatctctaaaacatatctttaatcaaattaaagataataacattttagaattaaaaatcaatgattatgccgatgtaaaaggacgtggatttattgaaggatattatggtaatccatggtctaatgaagatcgtgcagatttaatgacttttggaggagattataaattaaatcaatatatttatgctccaaaagatgatccaaaacataattcaaattggagaggtttatatactgaagatgaactagttgaagttcgtaagttagctgaagctggtaataaaagtaaatgttactatgtttatgcattacatacatttatgtataatccaatcagatttgatactgaagaaaactatcaaaatgatttaaatgttatcaaaacaaaatttgaacaattgatgggtgcaggagttaaacaatttgcaattttagcagatgatgcagctgttcctgctcaaggtgctcaatgctatgtgcgtttgatgacagatttaacaaactggttaattgaaaaacaagcaactgtatcagggttaaaatcagatatgattttctgtccaaatgattacacaggatttggtactagtgcacaaatgcaaacattaaaacaattaccagattctgtaagtattatccaaacaggtggtagagtttggggagaagttggtccaaacttcaacgaacagttttatagtaatatgggacgcccagcttatatgtggattaattggccatgtagtgataatactaaagatggattaattatgggtggagctgaagctgttttaaaaccaaatgttcgcccagaaactgtagaaggtattgttttaaatccaatgcaacaatctgaaccaagtaaagaagcattatttactaatgcagattatgcatggaatatttgggaagaggcaagtcattacgaaaaagtttggcatgattcatttaattatatggatcatggaactatcgaagatacacctgcttctatcgcattacgtgaattaagtaaacacatgatgaattctcaacaaattggtaatgaagaatcaattgaattaaaagatagattatcaagtttcatcaatgctttgaattcaggtagtgatattactgctagcgcagatgatttaattggtgaatttaaactattacaagatagcgctaacacatatcgtgaaaatccaggtaatgaaagaacaagagatcaaattatctattggttagattgctggcaagatacaacagaagcaattatcaattatttagaagcagcaaaaggattacaaaatggtgctgataatgatgaaatatgggataaattctcaacaggtcaagcagaatttgataaatctagaacacatggatttaattacgttgatcatattgaatatgcaaaagtaggtagaaaatatatctatccatttatgcaaaacttagatacaattttatctgttaaagtaggtactattgtaaatccagatcaacaaattgttacatttattacaaatcgtactgatacaccaactggttctactaaaagtgcattagataataatgcatctactgaattaacatataagagtccaaatactatttctactggaacatatgtaggtattagttatagtaaggcaattgatgttaacagtgttacttttagattaggacaaagtggtaacttaagagatacatttgctaaagcgaaggttgaatatacaactgatggaaaaacttggcaagatgttaatggtgaagaatatgaattaccacaagaagttactataagtgatcttgatttaaaagatgtaaaaggaattagaatgattgctactgctgataaagctaatacttggttaggtattcgtgatattgttgtaaatggaaaaggtgttgatgaaagtactggcgaaaaatattcaggtactgtaattaaatcaccaaattatggtatttatggatcatatggtgaagcaaatatgcttgatgatgatgataatacatttacatggtataaccaaaatactaaagttggagattatgtagggcttgacttaggagaagttgtacctctaggagttgtaagatttatcatgggtaatagtggaaacgattactggaatgcttatgacttagaatattcaacagacgggcaaagttatactgtatttgaaagctatacacaaaatcttgaaaagaaaacagtgactgctgatttaacaggtattaaagctcgttatgtaagagttagaaatacccaacctaagaatgtatggttaaagatgtctgattttagagtcaatcgaccaaatgatacttttgttgatacaaacaacgatagtttaaaagaaattgcaactaagattgatacaagtgttgcttcagttgcaacagttgaatcagcaactttaaatcaaaatgaatatttaggaattattttaccaagaattagagatttatctaatattaatttacaattagtaggtggagatgcattaacattacaagtatcaaaaaattatgttgattgggtagatgttgatgcaagtagtactgatttaccagatgctagatatgtaagattaataaataaaacagcagattcaattacatttggaattgaaaaatttgaagtatattcaaatgaaatctctgcaccattattattagattctgatattggtgttgatccaagctggggggtggctgaagatagtcgtgaaaatggagctgcatttgatggtgatatggacacttctactgagtttggttctactgttgaaaaaggacaatatattatttatgatttaggtcaagaaagaactattaataaattagcaatgtattgtcaagatagtgcagttaattatattcgtgatgctgaaatttttgtttctgataatttagacgaatggacaaaagttattacaattggtgatggtatagaaaatgttgatgaagcgaatgttacttgtataaattctgatgcaggttataaagcttctacaacttatccaaataaagtttatgttgaaggtagtgctgatagtgttaaggcacgttatattaaaattgttatgactgctcctaatacagaacgtgcagtattatttaatgaaatcgttattaatgatggtgaatatgtacctgtaattaacgatccaacatttagttcaagtgctattgaaaaacaaggatttgaaccccaagatatgtttgatggtaatttatcaacatcttatcgtcctgatactattaaagcaggatatattagttatacactttctgaaaaacttgatgtaactaagataaatattattcaaacaggtactgttagcaatgctaagttattagctttagttgatggtgaaagtgctagagaatgggtacaaataggtactttaaataaatcattaaatgaaatttatttaccattctgggaaaatatttatgaattaaaaattgaatgggatgcaaatagtgttccggcaatttctgaaattgtccttatgaatgatgatgcattactaccaaatcgtagtgtattacaagaatatattaatggtttaaatattgatgaagatgaatatacaccagaatcttatcaagtatttgctgaaaaattagctgctgctaatgaagtattagctaataataacagtaatcaaaaagctattgataatgcactagctgatttacaaacagctgtagaaaacttagttcctagtgttgaagctgataaaacagcattaaaaattgcaattgatctagcaaatgcaatcactgatgaagatttaactaatgttgtaccagcagtagctgatgaattcaaagcagcaagagatgaagctaatgctatttatggtgatagaggcgcaactcaagaagaagtaaataatgcatttgatcgacttgcaaatgcaatgcatatgttagactttgtaaaaggagataaaacagcattaaaagcattcatcgataaagtaagcggattagaagctgctaaatatacagaaactacatggacagcatttgaaacagaattaaatgaagcaattgctgtatataacgatgaaaatgcaatgcaagaagaagtaaacagtgcatacagtgaattagtaacagcattcttgaacttaagattaattccagataagagcttattagaagacttaatcaatcaagcaaatggattaaatagtgcaaattatacaaaagcaacatttgatggattaacaaaagcattaaatgaagcaaaagcagtatatgaaaatccaaatgcaacacaagaagaagtagacaatgcaaaagatgttctagccaaagcaattgccggattacaaacagtaacaactgataacacagtaagtacaccagtaaataatggtgatacaactacaagtgtaaaaactggagatgaaagcttagcgggaatgtttgcaacaatcgcattattaagtgtagctggatatacagtacttagaaaaaaagaagattaa

SEQ ID NO: 2444 - DNA, 2391 bp, Unknown
  Artificiall/Consensus sequence
atggatattagtttaaaagttttaaatagatatataaaagttgatgatcaagatcctaaggaacttgctgataaaattacttcaataggattagaagtagagggaatgcataatttagcaaatggtaataatatgacaattggtcatgtattagaatgtgttccacatcctgatagtgatcatttaaatgtttgtaaagtagaagtaaaacctggtgaaattagacaaattgtttgtggagcaccaaatgttgctactaatcaaaaagtaattgttgcaaatccaggatgtgatttaggtaatggatttattataaaagaaagtaaaattagaggtgtagaatctaatggaatgatctgttcgattgcagaacttggattagatcaaagattgttaaaacctgaagataaagaaggaatacatgtattggatgataatgcaccagttggtgaagatccattagaatatataggtcttaaagatacaattttggagataggtttaacaccaaaccgcgctgattgtatggcattaacttcatttgcatatgaagtaggtgcaattttaaaacgtgatgtaaatttaccaaaaattgaaacaaaaggaatagatggtagtggaataaatgttaaagtagatactgatttatgttctttttttggtgctaaattagtaaaaggtgttacaacaaaagaatcacctgaatggttaaaaaatgctttacttgctagtggaatcaaaccaattaacaacattgtggatatttcaaattttgtgatgttagaaactggtcaaccaattcatatgtatgattatgataaattaaataaaaaagagtttgtaattaaaacaggatttgattgtaaagaaatcttattagatggtgaagagtatacaattgaacctaatgatattattgtttcaactgatgatggaattggttgtgttgccggtgtcatgggatctaatagtacaaaaattgatgaaaatactacaaatattgtaattgaagttgctacttttgatggaacgactttaagagagactgcaagacgtttgaatttattaactgatgcatcacaacattatattaaaggagcactaaatacggctaattctttaaatattttggaaagatgtgcaaatttattggaagaactagctgatgctaaagaaatttataaaagtgtaacaactgatttaaatattgaagaacgatatgtagaagtttcaacaagtaaagtaaatggtttattaggaacaaatattagtactttagaaatagaagaaatatttaattcattaaagtttgaatttacattaaatggagagcaatttaatgttaaagtaccaacttatcgtaatgatattacaatggcagcagatttaattgaagaagtagcacgtatttatggatacgataaaataccatcaacattgcctgaaatgtctatgactgttggtaaaagaagcgatgttcaagcaaaaaaacatatgattcgtaatttgcttaaggaccaaggattacatgaaacattaacttattctttaacatcaccaacattagtagatgattttaatattttccatactaatgagacaattaaattagcaatgccgttaggagaagaaagaagtgtaactagaaaatcaataattagttcattgttacaagtaatcaactacaatcaatcacataatattaaagacgttaatgtttttgaattatctacaacatattctaaaaatactgaattacaaaacttagcaattgcttgttgtggtgaatataatggtttagcatttaaacaaatttcatataaagctgattattatttaatgaaaggttttgtagaaacaatctttaaaaatttaggtgtcgaagaatctcgttataaattagtacgagtagatcaaaatgatactaactatcatcctggtagatcagcatatataatgattggaaaagaaatagtaggtgtgattggtaatattcatccattaatggaaaagaaatataatgtaaaagatgtatatgttgtagaattgaatttaacaacattacttaacttaaaaacaagcaaagttaaattcgttgatattccaatgtatccatcagtaagtagagatattgctttagtaatggataaagatgttgctacatatgatatatgtcgtaaaattattcaagcaagtaaacaattggtaaaagaaactaaaatttttgatgtttatgaaggtgaacatattggagctaataaaaaatctgtagcaattaatttgattttccaagatccaaaaggaactttagaagaaaatactataaatgcagtaatggaaaagattttagaatcagtatcaaaagaatttaatgcagtattaagagcataa

SEQ ID NO: 2445 - DNA, 5562 bp, Unknown
  Artificiall/Consensus sequence
ttgaaaggaggaaaaaatttgaaaggaaaggaaagaatagctaagcgtgcatttaaggttttagttgctgctacaatggtagttactagcacacagtttggaagttttgcagtacaagccgaagtagaaagacaaaattttgctttgaatcaagaggctagtgctaactatgaagattcagctcatggctttgacgctgaaaaagcattcgacgggaatgatgaactttcatcacgctgggcagctaaagaaggggaacgtactggttggttgagtgttgatctaggtagagaacgtacatttgatgaatttagaatcttagctgaaaaagatgctcaaaaaattggaaagttcacaattgaaggttctcatgatggaaacgtttatgaaacaattttccaatcagaagacaaaacaaatgatggagggtatgatgttgattatactgtaaaactaaatgctccagtaacttatcgttatgttaagattactgttgaatcattagttgcaggtgcatatcctagtttatctttacgtgaatttgaagttttaggggataaagtcgctgaaactccaatgaatgaaaatttagctttaaataaagctgttacagcaagcgctgaatatggatcaatgccagcatctaatttaacagatgccgacaaagatagtcgttggtcaacagaaaaaaatgcaactcaatgggcgtatgttgatttaggacaaacatatgaaatgaacacatttgctatgatttgggaaagtgcaagcgtatatgcaagtgattataatatttatgtttctaatgatccaaataattggggagaagctgttgttagtcgaaatgggaatacatcagctagtagtactgaatttttacaagcgcctgtttcgggtcgttatgttaaattagaagtgacaaaacaatatggttatccaagtgtatcttgtcgtgattttgaagtaatgttaactgatggtcaacaattaccacaagatcctcaagaaaatgttgcattaaataaagatgctacatcaagttcaaatgaaacaagtggtctaaatgcttcaaaagcatttgatggtgatcatacaactagagattcaagatgggcaagtgccttaggaaacggaccacattggatcagtgttgatttaggtgaagtaagaaatataaaaacagttcgtttattctgggaaactagaaaagcaacagattatgaaatccaagtatctagcactggtgaagaagattcatggcaaacagttaaacatattgaatcacgtcctgcaattaaaactgatcgtattgttttagatgaagttgtacgtgcgcaatatgtacgtttaatggttaatgattttactgcacaagatccagatggaggagtagaatggaataatatttcactgtatgaaatggaagtatacggaggaataattgaagatagtgctagtgatatcgctaaccaaattacaattgaagaacctcaaaaaggcgatactgagttagttgtaaactatccagaaactgataaatatcttgttgaatacaatggtactgattttgaacaagtggttgatgaaaatttacatatttatcaaccaattgtagataaagttgtaaaagtatcatttaaaatcacagataaagaaacaaatgaatatgaattcaaagaaattggtattacaattcctggtaaatatcaacaagaagaaactgataatcctgcaccagtaattctacctgaattagctgaatggaaaggatttgaaggtaatttcacagttcttcctacatcaagaattgtatatagtaatgctgatttaaaagctgcagcagaagctatggctgaagattatgaattacttactggaaaagcaatcagtgttgttcaaggtgatcaacctcaagctggagacttctacttcgtccaaactacagacacatcaaaaggtctaatggaagaaggatatatcatggaagttgatgatgtaattacagttacgtcagaaactaaaacaggtgcttattgggcaactagaactatcttacaagctttaaaacaaagtgattacactacaattgctaaaggtgaaacaagagattatccactttatgaagtacgtggatttattatggatgtagctcgtaagacatttactttagattatttaaaacaacttgttaaagaaatgtcatggtataaaatgaatgacttccaagttcatttaaatgacaatttaattccattggaatattattcacaaaatggaatggatcctatggatgcttattctgcattccgtttggaatctgatattaaaaaaggtggaaataacggacttaaccaagctgatttaacaagtactgatttattctatactaaagatgaattccgtgaatttattaaagattcaagagaattaggtgttaatattgttcctgaaattgatacacctgctcactcattagctttaacaaaagttcgtcctgatttacgtaatggtacatatgggcgtgaaaacgatcatttgaatttagttagtaaatataatgaaagtttagaatttgtacaatcaattttttcagaatatatgactgaagaaaatccagtatttgatagtcaaacaactgtacatattggtgctgatgaatataacgcctcttctcaagcatatcgtaaattcgttaatgatatgttagactttgttgaaggaactggtcgtaaagccagagtttggggaagctttactcaagctagccaaggtgaagatatcgatgctgaaggtgtagaaattaatttatggaactttggttatgctaatatggatcaaatgtatgaagatggatttgatttaattaactgtaatgatggaaattattatattgttccaaatgccggttattactatgactatttaagtgattcaacaatgtacaaccttgatatcaacactattagcggtgtaacaatacctgctggtgatgatcaaatgaaaggtggagcttttgctgtatggaatgacatgactgactacttagataatggagttagtgaatatgatgtatatgatcgtattgaacgtggattaccattatttgcagcaaaactttggggtaaaggtgacatgaaccttgaagaagcaaaagctacttctgattctttaggtgatgccccaggtactaattttggatatgaagtagaaagtaaagaagatgctattttaaatatgccaatggatgaatatgaagatacatctgcaaatgaccatcaaattgaacaaggtgttaatgctcaaattgaaacagttgatttcaaaaatgcattaagattaaatggtggtcaaagctatatttctactgatttagaaactgtaggattgggtaatgatttacgtgtaaaagtaaagagaacatctgattcaacagaagaacaaattttatttgaaagtccttatggaaatatcaaagctgttcaaaaagatacaggaaaagttggtttctcaagagaaagatttgatttttcatttaactatacacttccagttaatgaatgggttgaattagaatttaagaaccaacaaaatagaatctctctatatgttaacggtgaattagtagatacattaggagatgatgaaagaattgaaggaagaccaatgttagcaacaacaatgttcccaattcaaacaatcggtagcaaaacaaatgctttcattggatatgttgatgatttacgtttaggtaaaaatgatacatttgcttcaacaatggcacttgattatgcaatctggaatggtgaagctgtattaactaatatggctaatgaacaattacgtacagttattgatgaagctaaatcagttttaactgaatatgcaccttcaaaagctacagttgattcatatgtaagtcaaattaatgatttattatctcaaatggattataaaaaagctgattatagtagattaaatgcttatttagcacttactaaagatttaagtgaatttactgatgaaagtgttgcaagtgtgaatcaagtaatagaaggtattcgtttaaatcttccagttcaattacaaagtacagttgatgcttatgaaaaagcattagtacaagctcttgataatcttgaacttaaagataaaacagatcctaatttagttgattcttctaaattaactgctactgcatcaagttatcaacaagatggatcaaatccatcaaatgtacttgatggttcaacttcaactatgtggcattcagcatggaatattacaacaatgcctcattacattgatttagaaattgatgaaagtacagaaataaaaggactcatttatactcctcgtcaatcaggaagcaatggtaacttattagaataccaaatccaagtaagtgataatggtgtggattatgaaacaattgcaactggaacattagaaaataatgcgcaagctaaaacaattaattttgctccagttacaacaaaacatgtacgtttagtttatgtaagagctgtaaataacaatgcctcagcttcagaaatcagtttaattcaagctaaggtaaatcctgatattgaaggattacaagcaataattgataatgctaaatcaatgagtaatgttggatatactgatgaaacatggacagcattccaagatgtaattaaagaagcagaagctctagttaatttggaaaatccaggtgctaatgaagtagaagcaatgaaacaaacaattgcttcaagcattgttgcacttcgtcttagcgaagaagaactagtagttgctgataaaacagcattacaaattgcagttgatttagctgataaagtaactgataaagatttagaaaatgtagttcctgtagttgcagaagaatttaaagcagcattacaagaagcaaaagaaattttagctgatgaaacagctagtcaagaagatgttaatgcatcatttgatcgacttgcaagtgtaatgcaaaaactagaattctacaaaggggataaaacagcattaaaagcatttattgatgatgtaagtaatttagattcaactaaatactcaacagatacatgggcagcatttgaaaaagaattaaatgaagcaattgctgtatatgaagatttaaatgcaatgcaagaagaagtaaataatgcacataaagaattagtaacagcattcttgaacttaagattaattccagataagagtttattagaagaattaatcaataaggcagaaggattaaatagtacaaactatacaaaagcaacatttgatggattaaaagatgcattaaatgaagcaaaagcagtatttaatgatccaaatgcaacacaagaacaagtaaataatgcaaaagatgtattagaaaaagcaatcaatagcttagaagtaattacaacagtagataacacaccaagtacaccggtagacaatggtgatactacaagtgttaaaactggcgatactacaaacttatggtattcacttgctactttaacacttgcatcagttgcattatatggaagtaaaaaaagaaaaaaataa

SEQ ID NO: 2446 - DNA, 2031 bp, Unknown
  Artificiall/Consensus sequence
atgtatggttgtaaagaaaatagagaactttcttggttaaaatttaatgatcgtgtattaatgcaggcaaaagattctaaagtaccactaggagaaaagcttaattttgtctctatattttcgtcaaatcttgatgaattttttatggttagaattggttctttatacgatcaaatgcttttctatcccgcatctagagataacaaaactgaaatgacaggagaagagcaattaaaaagttgcttaaaaaagattacttatcttaataagaaaaaagatcgcatttatcataacattttagatgaattaaaaacttatggttggggaattttaaaatattctcaattaaaagataaaaatgatcgtaaatatcttgaaaactattttgaaagagagatattacctcttatttctccacaagtaatttcaaaaagacaaccttttccttttttaaataatcgtgaattatatattgttgttcaattagaatcaaaaaaaggaaaacgtaaaatgggaattgtttcttgtggaaatgcgatggatgatcgaatgttagcaattcctagtatgcaaggtaagtttattttagttgaagatgttatattgcattttgtttcaaaaatatttgcgaaatatactattaaaaataaagcgtttattagagttactagaagtgctgatattgaagaagatgatcattcactggagggacatgatgattatcgtgaaatgatggaaaatttaatcaaacaacgacgtaaattaagtccgattcgtttagaaatgtctgaaggattagaagaactagaaatattgatgcttatgaattttttaaacttaaagaaaaatcaaatatttattagcacagcaccactagatttaaaatttattagtcaattacgtgataatttaaaatttatgcatccagaaatgttttataaaaaacttgaagcaaaaaacagtccattagttgaaaacagagttccaatgattaaacaaattttaaaacgagatattttacttacttatccatttgaatccatgtctccttttttaagattacttgaagaagcaagtcgagatccaagtgtagcaagtatcaaaatgacattatatcgtgttgctaaaaattcaaaaattgttaaatcgttgattagagcagctgaaaatggaaaagaggttgttgttttagtagaattacgagcacgttttgacgaagaaaataacattgattggtctaaacgtttagaagaatctggatgtcgtgttatatatggattagatggtttaaaagttcactcaaaaatatgcttgattacttgtaaaaataatcaaggaattcactatgtatgtcaaattggaactggtaattataatgaggtaacttctaaattatatacagatatatctttgatgacatctaagtatgaaattggtgaagaaattaatacaatctttaatcatttaagtttaggagaaactgaaagtaatacacaatatttaatggtagctcctaattgcatgattactaaaatatttgaatatatcgatgaacaaatagaacttgctaaaagtggtaaagaagcatatgtcggttttaaatgtaattctgtaactagtaaaagaatgattgataaattaattgaagcaagtcaagcaggagttaaaattgatatgattgttcgtggaatttgttgtatcattccaggggtacaaggttatactgaaaatattagagtgatttctatagtaggacgatatttagagcattctagaatttatatttttggaaaaggtgataatcaaaaagtatatatttcatctgctgatttaatgacaagaaatttagcacgacgcgtagaggttgctgcacctattttagatgaaaaaattaaaaaaagacttgtctcaatgtttaatacaatgttaaaagacaatgttaaagcttgtgagctattatcagatggtagttataaacgaattaaaaacaaattaccagaattaaacagtcaagaatatttttttaaataa

SEQ ID NO: 2447 - DNA, 2892 bp, Unknown
  Artificiall/Consensus sequence
atgaaaacatactgtggtttagaatatagttcaaaaattaaagcaacaattatcaatacaatcaatgaggcaaaagaaaatattttctctaattatttttttattgttgacgatcctcttttttttgaagaagctttttttaaatacactgatacattgttcaacattcaaattattaattatcaagatttaataaaccaattaattaataattatcagctacataaatatgaaaaactaacaaagcttgataaaattttaattactaaaaaattaattgaatcatctgataatatcttcaataataacaataaaatggatttaatttacgaactaataaacatttttgatctattttatcttgaagatattactacctcttctcttgataacttatcttcattatctaaacaaaaattagctacaattcttacattatataatacattaataaaaaatatcccacaaaacaaatgttatcaatatgaagaacttctattagataaaattgattcatctttacaaaacaatcactatatattcataacagaagaaatatttcacaaacgcccttacgatttaatcaaacaaatttctaaatatagcgatgtcatgattttaatgaattgtaatgatgaagatagaaactttaatatcccatttaaacaatatcacaataatgattactacactaaaaacgattctccatatttaaatcatttaaatacatatctattttcattaaaatcaccaaaatattcacaacccacaccattacattcattaattcaaacaacaccaaaagctcaaattgaaagtgtagtattaaacatctatcaaaatattattgaaaaaaatatgcattattatgattttgcaatatattatccaaatcaagaatatcttgatcttttaacagatacattaaacaatttcaatattcctcataacataaaaaaaacattgatatttaaagaattagatgcttgtattttgttacttaaatactatctaactcataacaaagatgatttattaaatttactcgatactaaaataatcaatggttatactgattacaattatatagatttaattaaaaaaagttacttagaaactaatcatcttgaagatccttttgaatcaaaatacaattttttagattgtcatacattatcagattactgtaatctaatgatttcatttataaaaaacgaaacatcatttagtgaaaatcagacaactttaatcaatttctttacaaatcttttagatgaacaatcatttactttaaatgaattttataacttagtaaacaatttaaaacctactttaaccgaagataaacaaatctataatgatcatgtatatctattaaattataatcaatgttatagcggtatattagattgtccatatgtatatcttgttggtgtaaatgaaacaattgttccaagtcaaataaaagacactgggatattattagataatgactatcaaactttaaatttacctgatttaaattatcaaataggattagaacaaaacaatattataaaaatactaaatagcaacactaactttcttgctatttgctttagtaatgccacaattgatggtcaaccattattaaaatcatcactatatgaacaattaaaacaaatgtttaactttactaaaatagatattagtaaagactacttacatcatagtttaaaaaacaaactatatttacagcttggtagagacgatacaacaaaacatttaaataatatgattgattactataaacaatcaaataaccaaccaacatctctcactaatcaagctaatacatcacacttgtcatctagtaaaatagaaacatataatagttgtccatataaatacttcgttcaatacgatttaaagctatatccgtttaaacaaccaactttacaaactaatgaaattggaagtatcgtccactatgttttagaaaaaacaaaaattctttttcaaaataaccaatcttcaaatgatattgattacaatcaattacaaagtcttattaataaatatgttgatgaatatattaatgataatgatttattagataaattagagcataatgctaataaatttattattaaaatgattaaattggatttagttaatactataattgttctaataaatcaaatgaaagtaagtgattttaaaatcgttggtagtgaggttaaaatttgtcaacaatatcctaattttaaattagatggagttgttgatcgaattgatcaatatgataaatacttaaaaataattgattataaatcaagtgacaaaaacttagatatctcacttgcaatccaaggttttaatattcaaatgttattatatttagatagcttaactaaacaaaagaagcttgaaaaaggtgccctactttacttcaatactaaaaaacgaattcttagtagtagtaaatcaataatagaagaagaaagcgacgaaaacttctttaaactttataaaatgaatggttatgtaaatgaagaaattattgaagaaattgataataatattgataaagaatcaaatattatcaaagcaaaatttgtaaaaaaatatgatagttataaaggtaatatattaagtagcttttcatttgagcgtttattagcatatgttaataaacatatccaagatttatatcaagagctaatttctggtaatataagcattagtccaaaaggaagtgatgaaactacaattcatactaaagtaaatccatgtaactattgtaattataaatctttatgtaactttgatattttttataatgaatatactttagtagatacaaataatcttgaatatttgattaaggaggaaaatgaaaatgccgattag

SEQ ID NO: 2448 - DNA, 2601 bp, Unknown
  Artificiall/Consensus sequence
atgagcgcattttacaacaaagatattgactctgttcgtcaagaagtcaatggttcattagaaccgctaagtaatcaacaagttaaaattaatcaagaaaaatatggtttaaatgaactagttgaaactaaagcaaaaagtattccaatgatttttttggagcaatataaggattttctagttataattcttatcgttgcagcattgatatctggttttttaggtgatatagaaagtgcaatagtaattttaattgttattacaatcaatgctattttaggtactgttcaaacagttaaggccgaacagtcattgaatagcttaaaagaattatcatcaccaagtgctaaagttttaagagatggaaaaattattgaaattccaagtaaagaagtgacaattggagatgaagttcatttagaagctggagattatattcctgctgatggaagaattattgaaaatgcaagtatgaaagttgatgaaagtgcattaactggagaaagcttagctgttgaaaaacaaactgatattatcgatggtcaagtagctttaggtgatcgtacgaacatggtttattctggtagctttgttacttatggacgtggaaaatttttagtaactgcaattggaatggaaacagaagttggtaaaattgcccaattattaaagtctactgaagaaaaaaagacaccattacaagttaatttagataattttggtaaaaagttatcaattataattatcgtattttgtgcaattttatttggattgaatatttatcaaggtggaaatattggcgatgcctttatgtttgcggttgctttagctgtagctgcaattcctgaagctttaagttcaattgtaacaattgtattatcttttggtacacaaaagatggctaaagaaggtgccattattcgtaaattacaagctgttgaaggattgggtagtgtttcaattatttgttcagacaaaacaggaactttaactcaaaacaaaatgacagttgaagattattatattgatgaaaaaagaatcatggctaaagatatcgatccatctaatccagttcataaagatttgatgagattaagtattttgtgtaatgattcaactaatatcgatggagaagaaattggagatcctacagaaacagcattaattaatttagctgataaattaggaattccaccacaacgagttagaaaagcatatccaagattaagcgaattaccttttgatagtgatcgtaaaatgatgtctacattccatcttttaaaagatggttatacaatggttactaaaggtgccgttgatgttttaattaaaagaacaaaatatattagaaaaaatggtgaagtattaccaattaatgaaaatgatattaaaaatatcaatgaaatgaatctagaattttcaagaaatgggttacgtgtattagcagttgcttatcgaaaatttgatcaagaaaaaacattagtgcctgaagatgaaaatgatttaattttcttaggtttaatttcaatgatggatcctccaagagttgaaagtgctgccgcggtagaagaatgtatcaaagctggtattataccaattatgattactggtgaccacaaaattacagcttcagcgattgctaaaagaattggtattttaactgatgaatcacaagctgttgaaggtagtgaaatcgataatttaactgatgagcagttaaaagactttgtcgaagataaacgtgtttatgcaagagtttctccagaacataaaattagaattgttcgtgcatggcaagaaaaaggaaatattgtttcgatgactggtgatggtgttaatgatgcaccggctttaaaacaagctaatattggtgtcgcaatgggaattactggtagtgaagtttctaaagatgcagcatcaatggttttaacagatgataactttgcaacaattgttaaggcaattgaaaatggacgaaatgtttatgctcacattaaagatgctattcaatttttattgtctggtaactttggaggtattttagcggttttatatgcttcaattatggcattaccggttccatttgcaccagtgcatttattgtttattaacttgcttactgatagtttaccggcaattgcacttggactagaaccacatagtaagaaagtaatggaagaaaaaccacgaccaatgaatgaatcaattttaactaaaccatttttaactagtgtaggaattgaagggtttgtaattgcagtaatgacaatgattgcatttacaattggatatcaagataaaaatgctactttagctagtacaatggcttttgcaacattatgtttatctagattagttcatgggtataactgtaaatcaaaaagtcctattttatttaaaaagggattcttcaataataagtttttacaaggtgcatttttaattgggtttgtgttaattacattagtagttacaatgccatttttacaaacaatgtttaaagtacaaactttaacaatgccacaattatttactgtttatggtttagcgttagcaaatttaccaataatccaattacttaaatggattagaaatagataa

SEQ ID NO: 2449 - DNA, 3426 bp, Unknown
  Artificiall/Consensus sequence
atggattgtttagataatattttaaaacagaacttagcttttaatgctttgttaaatggtaaaggaaatatcgtcgttaatgatgttagcgatgaggcactattattaactagtgcctttttgaagttgaaaaggaatattgttgtagtgaaggctaatcaatacgaggcaaatatgctttatcaaaaagtaatgttacttaatgaaaaagatgtttcattgtttgcagtagatgaatcatatcgtattgaagctttagcagcatctcctgaattgttaggacaaagaattgatacaatgtatcaattaactaaaaatgaacctagaattttaattactcatagtcaggcaataataagatatttgccaactaaacaattatttatagataattgtttaaaaataaaagtaggaatgcaaatagatatttatgatttaaaagcaagtttgttaaaatcaggatatcaaagtataattagagttgatcagcctttttatttttctaaacgtggtggtgtaattgatgttttttcaattcaatacgagaatccaattagaattgaattttttgatgatgaaatagaaagtattcgtttttataatcaaaatactcaaagaacaatagaaaatattaatgaaataacaatcttaccagcaagcgatattttatatgatgatcaagaagtgacaaaagtcattagtaaaattaatgatttaagggatagtcaagctgaaatattagatgaattatatttagaggattttttaaataaagtatcgattgaccaagaaaatcttcgaaatcatgatacaagtttttcaatgtattcatattataatttatttaaccaaacaactagtattagtgattatctagatgatcctttgatcattctttcaaatagccaagatattaattttgcttttaaaaattatctagaagaaaatttttattattatcaagaattaattaatgttggtaaaagtgtaaagggtttgaatttatttagagatctttatgaagttacagataaagcaacgatagaatttaaatcatttgcaacagatgaaaaagatgtgatatttaatggtcgaactgttatgattgatagtcaagatgaaaagatgctgattagtcaaattagaagttatttaaaactatcgacagtaattattgcattagatgatgaacgtcaaattcgtttaattagtgaattattaaatcgccatgagcttttatacactatgctagataatagtggtgaattttattcagggttaaatcttgttattgataaaatcggttttggttttgagttagttgatgaaaatattgttgttattagttctaatgagttatttaagactaaaaatgtaaaaaaacctaagtattttaaatataaaaatgctaaggttttaaaggattatcaagaattagaaattggtgattatgtagttcatgataattatggaataggtcaatacttaggaattaaaactttagaggtacaaggggttcaccgtgattatttatatgtagcttatgctggagatgatacattatacattcctgttgaacaatttaatttagtgcgtaaatattcaagtagtgaagggaaagtgcctaagattaataaattaggtagttcacagtggcaaaaagttaaagctaaagcgagaaataaagttgatgatattgcagataaattaattgaaatatatgctgcaagaatgaatcaaacaggttatgcgttccctgttgataatgaaatgcaatttgaatttgaaaatgcatttggttatgaattaacagaagatcaagtacgctcagttaaagaaattaaagaagatatggaaaaaccgcaaccaatggaccgtcttttatgtggagatgttggttttggtaaaactgaagtagcattaagagcagtttttaaagctattttgggtaataaacaagtggcatttttgtgtccaacaacgattttatcaatgcaacattataaaacaatgttagatcgttttgaaaattttccagtaaaagttgctttattaaatcgttttacttcaactaaacaaaaaaatcaaattttaaaagatcttaaagaaggaaatattgatttattagttggaacacatcgaattttatctaaagatgttgaatttaaagatattggtttattgtgtattgatgaagaacagcgttttggagttaaacaaaaagagaaaattaaagaatatcgaaaaacaattgatgttttgacacttagtgctactccaattcctagaacattacaaatgtcattaatggggattagaggtttatcacaaatagaaacgccacctaaaaatcgtcaaccggtacaaacatatgtaattgaaaaaaatgatgtattgattaaacaaattattgaacgtgaattagcacgtgatggacaagttttttatttacacaatcgaacaagtaatattgccaatactgcagataaaattggtagaatggtacctggcgctaaagttgttgttggtcatggaaaaatggataaaaatgaaatagaagatgtaatgatgcgttttgtaaataaggaatacaatgttcttatttgtacaacaattattgaaacaggaattgatatcccaaatgctaatactataatagttgaaaatgctgataaattcggtttaagtcaactttaccaaattaaagggcgtgttgggcgtagtaatcgaggtgcttatgcatatttattatataatccatctaaagtattaactgaagaagctagtaaacgattaaaagcgattaaggaatttactgaattaggcagtggttataaaattgcaatgcgtgatcttgcaattagaggagctggagatattttaggtggaacacaatctggtttcatcgattcaattggatttgatatgtttataaaaatattacaagattcggttaatcaaaaaatgggaaaacaagaacaagaaattgatattaaaagtgtaaatgtcaatgttgatggctatattcctcatgattatgtatctagcgatattgaaaaattagagttatatcaacgattagataatactaaaacaattaaggcgattgatcatttaaaaactgaatttattgattattatggtaaattacctgatgaagtttcagctttgattgaaaaacgtaagcttgatattttagcttcatcaaaaattattgatgttttagaagaaaagaaaggtaatattgaaattacttttagtagtgattatagcaaaaatgtaaaaggagatcagttgtttgaattagtaaatcgtttgtttactagacctagatttaaacaaattgataataaaatagtaattatactaccaaaaggtaatcagtggttaaatagattaaatgaattaattagtatgcttagttaa

SEQ ID NO: 2450 - DNA, 3057 bp, Unknown
  Artificiall/Consensus sequence
atgatgctaggacatttacaagtatatagtgcgtatagttttcaaaatagtactattttaatcgaagacctgtgtaaaaaagctagtgatctccactatgaggcactagctttaactgataaggataatatgtttggggcaatggaatttacaaaatgttgtgctaaatatggaattaagccaatatatggtttagaagcaagtgttgaaattgatcatgaaatatatccgttgattttacttgctaaagatacatctggttattttagtttagttaaaattaccagtgatatttctttaagtgataataaagcaattaaatttgatgatttagtgaaacatcaagaacatttatttgttttatcaggatgtaaagaaggaattattgaacgattgattttaaaagagcttgatagtgaagcacttaaatatttgaagttatttaaaaatagttttgataatttttatgtttgtttacaaaatcataatctagcaatgcagcataaagttaatgagcgtttaattgcgttaactctattagaaaatattccaatttgtgtatcaaatgaagttagatatttagaaagtaaagaagcatacacattagaattgttgcaagcttttagtaaaggacaaacattagatattaatcatgaaccagtaactgatcagctatatttaaaatctagttatgaaatggaaagtatttttgataaaaaatatattgaaaatactgattatattataaacttatgtaacgcctcaattcctcttcatcacatgcatttacctaagtatccagtgcctaaaaatggtaatgctagcgattatttaaaacaactttgtagtgtaggattaaaaaaacgttttaaaaatcaaaaaataaatcctgcatatttacaaagattaaagaaagaattagatgttattacaaaaatgggattcgatgattattttttaatagtttttgattatgtaaggtatgctaaagtcaataaaatattagtagggccaggtagaggttcggctgctggtagtttagttgcttatgtacttggaattacaaatatcgatccattaaaatataatttagtttttgaacgctttttaaatgaagaacgtgttagtatgccagatattgatattgattttcaagatgatcgacgtgatgaaattgttgaatatgttactaataaatatggtcaagaacatgtaggtcaaattgttactttttcaacttatggtcctaaagtagcaattaaagatcttggtaaagttttaaaaatcgctttaccacgtctagaactattggctaaaaatatcccaacaggacctaaaaatcgcaaaagtgcaaaagaagtatatgaaacatcatataattttcaatcaatggttaatcgcgatttagcattaagacgaattatgccatctgtttttattgttgaaaaattaccacgaaatatttcaacacatgcagctggagttgttttgtctaatgatcgacttaatcaagttgttccattgactagaggtcctaataatggaattgttacccaatattcaaaagattatattgaagatgtgggattgttaaagatggattttttaggattaaaaaatttaacgatcattgattatattttaaaagatattgaaaaaaatgatggaagaaaaataaatattaatgaaattgagttaaatgataaaaaaacatttcaattaataagtagaggagatacttttggtatttttcaattagaatcaccaggaatgaaaaatttattaattaaaatgcaatgtaattgtttagatgatcttattgcagctattgctttatttagacctggtccaatggctaatattcctgcctatattgcaagaaaaaaaggggaagaaccagtaacttatccgttagactgtttaaaaccgattttatcatcgacatatggaataattatctatcaagagcaaataatgcaagttgctcaaagagtagctggtttttcacttgcaaaagccgatattttaagaaaagctatgtcagataagatagttagcttaatggcatcaatgaaaaccgaatttattaacggtggaatagcaaatggttttagtgaaagtgaagcggtaggaatatttgaattaattgaaaaatttgcaaattatggttttaataaagctcattcagttgcttatggctatgttgcttattggttagcttatttaaaagccaattacccattagagttttttagtgctttgttgtcaaatgaacagagtagtgattcaaataagattaattgtatccaagagggtaaaaagtatggtgttaaaatattaccaccatcaataaattattcaactgatcgttttaaagtagaagatggcaatattcgctattcacttttagcaattaaaaatgttggatatgctggttatcaagcaattgttcaagaaagagaaaaagggttatttaaagatgtatttgactttatttctagaatggagtctagtaaacttaatagtaaaatgattgatagtttaataatggcaggagcttttgatgagtttgaacttaatcgaagcactattaaatataatttaagccatattatggaatatgctcagttaaagaatatgattggaattgatgaaccgccaattttaaccatagtcaaagataatcgtatgaaggttttggaagaggaaaagttggttttaggtgtttatttatcaatgcatccaattgctttaattaagcaaaatttaaacctcaaaattataagtgtaagtgaattgcataataacattgataaatatgttacaatagtaatggcaatatcaagagtaaaagcaattgttgataaaaaaggtcaagaaatgtgttttgttgatggatacgatgaaactggtgaaattgatggagttgtatttgccaataattatcaaacattgaaaaacgtgttagtgcgtggtgatatttgtttaatagaaggacaagtgaaatttcgtgataaattatcgttggtgatttatcaagctaaaaaagtacgttaa

SEQ ID NO: 2451 - DNA, 2136 bp, Unknown
  Artificiall/Consensus sequence
atgaatcagtttaagggtgcaaagatagcttatgttgtctttgcattagttattttttctttagttgtaaatattgtatatctaggaatcacaggaaaacatttgattagtggttcagatataaaaacttatgcaaaaaatagaggaaaaagtgaaagtattgaatatgcaactagaggatcgatctatactagtgataacgaggttattgcaaaaagtgttagaaacttcaaattaagtgcagtcgtctctaaaaaaagagaaggtaaaaatgcctatgtaaaagatattaaaaaaactgctcaagaagttgctccaattattggtatggatccaaatgaaatggaacagaaaatgcaagaagcagttgatgcaggtaaatatcaaattgaatttggaacatatggtaataatttaacaatgggtcaaaaaacagaaattgaaaagaaagatttacctggtttagtttttgaagaagttaatactcgcaattatcctttaggtgattttagtagttatattgttggttatgctaaaaatacaactgatgaagatggtgtaaaaaaattagttggtgaaatgggaattgagcggaattatgatgaagttcttgcgggtaagaatggttatcgagtttatgaaaaaacagcagatggttatgttagaactaatggtattttaaagaaaaaagatgctgttaatggaaaagatatatatttaacattaaatagttctttgcaacgagatttagattatttattagctaaagaagcaggtgaagctggagcaagtaatgcttcgtgtgttgtaatggaagcaaaaacggggaaaattctagctttatctacttatccatcatttgatcctaataaaagagatattaaaggatataataatttcttttttgattcagcatatgaatgtggatcagtatttaaatcatttgtttatgcaagctcaattgaaagtggattgtataatggaagtgcactttatcaatctggtaaatatgattatggtgctagtagaccaattagagatcataataatggtgttggttggggtgctattagctatgatgaaggattttatcgttcaagtaatgtggcgatttgtaacttattagaaggtggatatacaaataaagaagatgtactacaaacttatgaagatcttggtttttttaaatcagatgaagtagatggttttacaacggctaaaggtacagcggtttatgaaaatgataaaagtagagcagcatatttgactactggatttggtcaagggtcaactgtaacaatgtatcaattaattagagcatatagtgtttttgcaaatgatggtaagatggtagaaccatatattgttgatcgcattgttgataatgaaaataatgaagttgcctatagtgctaaaactgaatactcaaaacaaattttttcttcatcaacagtatcaaaaattagagatttattaaaaggtgttgttagtgatgaaactggtactgcaaaaaaatttgctcttgaaaacggtgtacagattattggtaaaacaggaactggacaaatggtagatgaaaatggtacttattcaagtagtaattatactaaatcatttgcaggtatggcgccttatgatgatccacaaattattactttagttgtttttcaaggtgaagataatagtacaacagatcatcaagctaatattatcaagaatatcgtgccatctgcattatcagttgtttcttcatataatagtaatgatgatgtaactgaaataaaaaattataagttagattcttttgtcaatcaaagtgttaattttgttaaatcaaaattacaagctaaaaatattgacgtacaagttattggtaatggctcaactgttattgaacaattcccaaaagcaaagtctaaagtaacaaaaagtgatcgtgtttttataaaaaccgaatctagtgatattactttacctgattttagtgggtggtcaagtaaagatgtctcgatttttggctccttggcgggaataacgataaatactgaaggtagtggcggttttgtcattggacaaaatataccaccaggaacactagtacatagtggtgattcattaactattacattagggtga

SEQ ID NO: 2452 - DNA, 1911 bp, Unknown
  Artificiall/Consensus sequence
atgataatgaaagatggatatatacgtatagctgcagcctcgtttgatacaaatattgcagatattaaaaataatagtttacaaatctgtaaactaattgaacaagcttatgaaaataaagcaaaaataattgtatttccagaattatgtttaacaggatatacatgtgaagacttatttaatcaagatcgtttattaaatgaagctaaatttcaattacaaaatattattgaaaaaacaattaataaagatattattgtggtagtaggtttaccatatcagcatttaaatagtctatataatgtagcagcaattattcatagtggtaaattattaggtctagttcctaaaactcatgttcctaattatcaagaattttatgaagctagacgttttgaaaaagcaccatcaaaaaatacaaccgtattttttaatggtcaaactactccatttggtactaaatatatttttgcttcatcaactaattgtgaatttaaatttggagttgaaatttgtgaggatctctggttgcctgatgccccaagtattgatcttgccttaaatggtgcaacattaattttaaatccttcagctagtaatgaaataacaactaaaaaagactatcgtcgcttattagtaaaatcacaatctgcacgattaatttgtggatatgtttattgtaacgctggaaatggtgaaagtactactgatgtagtatttagtggtcatcatattattagcgaaaatggtaccatcatcaatgaaagtcaaggatttaatagtgagataatatatggcgatttagatctgaaaaaattatctagcgaaagacgtaaaatgaccacttttaaatcaaaagatgagtatgaaacaatatattttgattcaactaatattgatctagatacaacatattattatgaccctcatccttttgtacctaataatttagaacttagagaaaaacgctgtaaagaagtttttgatattcaaacttatggattgatgcaaagattaaaagcaacaaatattaaaaaagttgtaattggtatttctggagggttagattctactttagcattacttgtttgtacaatggcatttaaaaaattaaattatgatactaaagatatcatcgcaattacaatgccttgttttggaacaacttctagaactaaaaataacgccttaggattaatgaaagaattaaatgttacaagttatgatattgatattagtgaatctgtaaaaatacaatttagagatattgaacaagatgaaaccattcatgatgttacttatgaaaatgttcaagcccgtaccagaactgaaattttaatgaataaagcaaatcaagttggtggtttagttattggaacaggtgatttgtctgaagttgctttaggttggtcaacttataatggtgatcatatgagtatgtatgctgttaatgtttctgttccaaaaactttagttcgttatttagttgattatgtatctagtttatatcgtggtcaaaaattagaagctattttaaaagatgttttagatactcctgtttcacctgaattattacctcaacaagatgataaaatagttcaaaaaactgaagatatcgtaggaccatatgaattacatgatttctttatttatcatatgattcgttttagcgatgaaccaaaaaaactattaagaaaaactaaattagcttttaaagataaatacgataatgaaacaattaaaaaatggttaattaaattttattggcgttttttcacccaacaatttaaacgcagttgtattcctgatggtcctaaagttggtagtgtttcactttctccacgtggagactggagaatgcctagtgatgctagtgtaaaagaatggattcatgaattagaaaataattaa

SEQ ID NO: 2453 - DNA, 2634 bp, Unknown
  Artificiall/Consensus sequence
atggcaagtagaaaagaagaaattagaaaagaaataaaaaagaagaatgaaaaagaaggtcttaatcctgaagcagtaaataatattgttgatttacaagaccaaactggtgaagatattaaggtagaagatttccaaggggtatatgatggaaatgttattccttttagtacaacaccacattcaactaaaaaaagtttaattggaaaaattaaaggaatctttgatgatgaaaataaacaattgaaaaagcttgataaaatggcagatcaaattattgccttagagtcaacttatgaatctttaacagatgaacaattagctaataaaacaaatgaatttaaagaagctttagctaatggaaaaacattagatgatattattattgatgcttttgcagtagttagagaagctgcatatcgtaaattaggattaaaagcatttaaagtacagttaatgggtggtattactttacatgaaggtgatattgcagaaatgaaaacaggtgaagggaaaacattaacatctattttcccagtttatttaaatgctttaacaggaaaaggggtacatgtagttactgtaaatgattatttagcaggacgtgatgctgctaataatggtcaagtatttaactttttggggcttacagttggtttaaataaacgtgaacttacaccagctcaaaaacaagaggctcatggttgtgatgttacttatacaactaatgctgaacttggatttgattatttaagagataatatggtgactaaattagaagataaagtattagttcatggtttaaattatgctttaattgacgaagttgattctattttaattgatgaatctagaacaccattaattatttctggtggacgtaaaaatactgctgctttatatttacaagcagatcgttttgttaaatcattaaaagctgatgaagattatgaagttgatattgaaagtaaaactgttgctttaacagctcaagggattacgaaagctgaaaaaggatttaaaatttctaacttatatgatccacaacatacatcattagttcatcatattaatcaagcattaaaagctaactatgcaatgactcgtgatgttgaatatatgattgctactgaagatggtagtcgtgatattagaaatgctaagatcatgattattgaccaatttactggacgtgtaatgccaggacgtgcttattctgatggtttacatcaagctattgaagctaaagaaggagtaccaattaaagaagaaactgaaacacgtgctacaattacatatcaaaatttctttagattatttaataaattagcagggatgactggtactgcaaaaacagaagaagaagaatttagattgatttataacatgcgtgttattgaaattccaactaataaaccagttattcgtgatgatcgtaatgataagatttattcgacaaaagttaataaatttaaagcgttatgtgatgaagttgttgctcgtaatgcgtatggtcaacctattttgattggtacagtttctgtagaaacatcagaagtgttatcaagaatgttagatcgtcgtaaaattaaacataatgtattaaatgctaaaaaccatgctaaagaagctgaaattattgaaagagctggtcaacgtggagctgttactattgcaactaacatggctggtcgtggtactgacatcaaattaggtgaaggtgttgctgaaattggtggtttagctgttattggttctgaacgtcatgaatctagacgtattgacaatcagttgagaggacgttctggtcgtcaaggtgatccaggatattcagtgttctatgtatcatttgaagatgaattgatggaacgttttgcaggtgaaagattaaaatcatttacagaatatttagaagatgatcaagcaattgaaaacaaggttgttacaaaagctattgaaagtgctcaaaaacgtgtagaaggtcaaaactttgattcacgtaaacatattcttgaatatgatgatgtaatgcgtcaacaacgtgaaatcatgtataaagaacgtgatgatattatgtctgaagaaagcttagatgatattattaagggaatgtttaatcaggcaattgaaatgactgtaaaacattttactaaaaatgatggtaaacatgatgtaattgatgttgagggagttgttgattttgttgctaaaaactatatgttattagtagaagtcaacgctactaattgtgaagcattagtgcatgatcctaaaaaattaattgatacacttactgaattggtatataaccaatataacagtcgttttaatacagaattagaacctgaaagaagattgcaatatgaaagaagtgttcttttaggagtaattgattatacatggatcaatcatattgatgcgatgactaaattacgtaatggtatttatttaagagcttatgctcaaaaagacccattagcagaatatacagaagaagcattctatatgtttgaacaaatgactatgacaattgcagatactatttctcgtaatattattcatatgggtattcgtccaggtagtgaaattgaacaagctatcccacatttaaagatggaacttacttttaaataa

SEQ ID NO: 2454 - DNA, 3006 bp, Unknown
  Artificiall/Consensus sequence
atgtcagcttttggtccttatcaaaatgttgtagaaattaattttgatatttttaaacaagatggtttatttttaattaccggaccaacaggggctggtaaaacgatgatttttgatgctattacatttgccttatatggtgtttctagtgggggtgaacgtagtgtagaacaatttagatgtaatagtgctaaaaatgatgttgctacatatgtaattttagattttacattgcataatcaacgttatgtgattaaacgttcgccaaaatatactttagaaggaagaaaaactcctaaaatgcctacagcattattaacattacctaatggtaaaattattgatggagtaaaagaagtaaatactaaagtaaaagagcttttaggaattgatgaaaagcaatttaaacaaattgcaatgattgcccaaggtaaatttacagagttgatatatgctggtagtgatgaaagagaaaaggtattaagaaatttatttaaaactgataatctagtttatttagaagaacaattaaaagataaggtaagagaatatcgtaataaatatgatgtattatttagacaacgtgaattattaaaagaaaatttagatattgaagatgataattatcagaattatttaaatgattttgaaaagaaactagatgatgatgaaaaaaaatatcaagagcagtttgaaaaatatacccaaataaatcaattattaaatattacaactttgaataatcaaagacttgataaacttgataatttaaaaataaaattaaataattatctagataatgaaaaatattatcaagaattaaaagaaaatattgctctgttaaaaaaggcaatgagtttacaaacagattatcaaaatacagtacattgtaaaataaaaattgataaattattaacagattatcaaaatacaaaagaaacaaaagaaaaaacaaaaaaagaattaattgataaagaaaaagaatatcaaaaaaaatctacttatcaaaatcaaaaagctaaattacaactagaactacaaaaaaataaagaattaaaacaaaaatatcaagaatatcaaaaagatgtttcaaaacaaacttcaataaataaacaaatcaacattattaaaagtaaactagttggcctagaagataagcaacaaaaatatcaaaaaatgattgaaagtgataatgatagtgtttctaaattagataaattgaaaagtgactataaattagttgataaagaatatcaaaaattacatcaatataaattacaagtacatcaattaagtgaagattatgataaattattatttgctgaagaggaaaattatgatttacaagatgaatatcaaagagtagaaagtatttatatggaagaaaaggtaaaatatgatactcttgaaaatcgttttcgtttaagtcaggcggggattttagctagtcaattgaaagaaaatcagccttgtcctgtatgtggttcattaaatcatcctcatttagccaattttaatgaagggattgtttatcaagatgatttaaaaaatgctaaacaggtatttgataaatgtagtgagcgtagaaatgatttgtataatacattaatgttaaaaaaacaagaaattgttttgcttcaaaataaattaaatagtgattctaaacggttaggaattgaagaggagctagataaggaagtttttattaaggtacttggaagtgttaatattgaagaaaagagtttgtttgatagagctaaagagctaaatgatgaaattatttatttgaataagttaaaaattagtttagataatcaccgtaatgatttaaaaataattgaaaagcaaataagtgatgctattgaacagatggatctttataaagcatctttaaatcaaattgttggtagaattgaatctttggatcatttaaaagaattaagtgatgataagattaataagatgattagtgataatgaaaaagaaattattgatttggatttattaattgatcgtcttgaaagtgagtatcgtagtttaaatgataagtgtattcaattagaaactaatacacaattgattgataaacaattaagtgatgaaaatgataattatcaaagattaataactatttataaaaatagacttcataaattgtttgatagtgaagaagtatttttagctttatcattgcaattagatacattgactgataaagaaaaagaatataatgattatttaattggtaaagagacgttacaaaatcaaattaaagaattagaagaagagttaaaggatgtaaaatatattgatattactgaaatggaaaaagatagtaattgtttaaaagaacagttaaataatttacaaattgatttgaataagcaaaaagcaaaattaattactattcgtaatacaattgaaaatattataaatattgataaacaattaaatgatagttatgatatttatcaacagtatttggatttaagtgaattgacatcaggtaaaaatgagtatcgaatttcatttgaacgatatgttttagctgcttattttgaaaatattttaacttatgctaatattttattgaagcgaatgtctcaaggaagatatcagttatatcgacgtgataatcgttctaaaggtgcgggaaaacaaggattagaattagatgttttagatttagaaaatggaatgcttagagatgttaagacgttatctgggggagaatcgtttaaagcggcattgtctttagcattaggtttatctaaaatgattcaaagttttgctggaggaattgagctaaatacattatttattgatgaaggatttggttctttggatagtcagtcattagatcaagcaattgattgtttgattgatttgcagcaagatggaaaattaattggaataatttctcatgttagtgagttaaaagaaaggatagatcataaaattattctttctagagtgaataaagaaacgtatatttctattgaataa

SEQ ID NO: 2455 - DNA, 4620 bp, Unknown
  Artificiall/Consensus sequence
atgacatttatagattatttaacagacatgaatgttatgccaggggaagatgaatttatgaaaaaaaattcagttaaaaagtttttggtaagtattctcgctgtaacaacaatgtttggtacgtcggtttcgacaagcgtagcattaaatggtgaaaatacggcgactagcggtggtgctaatcttttggatgagcttactgcaggagaaacaatttctactaaacagtatgcaccggatgagattgtaacagtagttgttgaattagatggtaaaactactttagacgtagatgaatatgttactaagtttaaaaatgatagtattgcttattctactgatgaatctgtaactgcttatcgagcagatatggtaagtcaacaagataaaataaaaaaagaaatttcagaatttgctcctgatacagtatataaatatcactatactaatttacttaatggttttgcagcacaagttgagtatcaatacatagaaaaaatcaaaaagttagatggagtaaaatctgtttacatgacacaaacttataattatgatgccaattggcaagaagaagaaaatgcagaatacatatctttggaagattattatgaacttactggatgtgatgctattgatgtaagcaagtctgttaaatctgatgctggttctgctagccaaatggggcttgaagcagcttgggaagctggttatactggtgcgggcaaagttgttggagtttttgatagcagtatccgttacacacataaattattttcttatatggatcctgaagtagaaaaagctggtgaagctggtttactttctaactataaaacaaaagaaaatttacttgatgttgttaaagcaaatcaaagtacattaaacttatttgtagaaggttggggaagttggttccatggttttgatgaaactggtttttcagaagatgtacaacaagatattttaaatggagatttctattataactctaaagttccattctctgttgattatgcttgcggtgatttagatgcatgggatggggattctagtagtcatggtacacatgttagtggaattgttgccggtaatggcggtgaaggttatgatgaaatttccggcgttaaaggtgctgcttatgatgctcaaatcatgttctttaaagtatttgatgaaaatgatgattttggtcaagaatctgatgaagccgtatttgctgctttggatgatgcagttactttgggtgtaaatgcatttaacttatctcttggtattcctaatgggtttacaactatgaatacttacgctcaagctggatatcaacaagcttataatcgtgcacatgctagcggtattactatcaatatttctgcaggtaatgatgctcgtgatagtcatccaggagcgctagttaatggatatactacattattacctaatagttcagcaggtggattctctggttcattatacgcacctatgactgttgcttcagctcaaggtataggatattcttatattaacaaatacacagaaactactgctactgctgtaaattcaaatagtgaaactgttaatactattatgattagtgatctttatagtccggcactaggtgaagtattaaatggtacttatgaattagttgattgtggtgatggttcttccattacacaagacttaactggtaaagtagctttagtaaaacgtgtttatggttatgttccttatgatgaagcaggtatcatagctgctcaagaaaatgcttataaagctggtgctgtggccgtatatatgacttttgattattatagtgattattttggtactaatggtttatggactggtgcaagtggtgaaagcattcctgtttttgctggtacagctactagcagtgatgtttataatgctttagtatctgctattgctaatggtactgtaaatgtaactttctcttcagaagataaatctgaaactataactcgtaattataatgataacggaccagctggttctacttcttggggtgtaagtgaatctatgaatttaaaaccagatgtaatggctccaggaggaaatatttggtctgcaggagcatcatcagatactgcactatcttcaaagagtggtacttctatggcttcaccaaatgcagaaggattatttattcttgctcaacagtatgtagatgataatcttgatacttttggagtaaaaactggaactcatgaatatgttgaattgataaatcagttagtagcttctactgcaatagcttatcaaccatttgtaagttcagaagatttgacacgtcagaacttgtatttctctccaagacgtcaaggtgctggtatggctaatattgaaaatgtaattaatagcttggttttattacgtaatgatactgtatttgatccaattactggagattctcctcgtactaaagtacaattaggtgataaattaggtacaacttttgatattacatttaatatggataactacgattctgtagcaaagacatttgatgtacttgcatgtcttcaaactgataatactacagaatcagatggacgcactattattgctcctgttaatacttatggttcagatattgatgcaattgaagatggtgtaatgaaagttactgctgtttctaatggtactattgtcagtgaatctaataatattaaccgttatggtaatgatgcatctgcaacaaaaatttctgttcctgctaatagttcaactaaaattacagttagtgtaactttgaatgaagaaacaatgaaagcttatgatgaaaaatatcctaatggtatgttcttagaaggatttgttttctttgataatgtagattctgattatgaaactcttagcattccttatttaggatttagaggtgattggaatgcagctccaatctttgatttagcaactgcttatgatgacatcagtgaattagatactactgatgaaaaatatccattgttccatacaacaactttaaattctttagttgatggatatgatgtggttttaggtgcaaatcaatttacaggaacatctttaccagattactttggaggatcttctacaagttattacaatacaattcgtagctatttagatgatcttcgtacaaatggtgaattaaatggttcttatgttactatatctccaaatgaagatggtaaggatgatattgcttatgcagcgctttatttattacgtaatgccaaagcactatgtgtagtaattaaagatgaaaatgggaatgttgttaatgtaattggtcctgaatatgaatattttgaagcaaaagttaatgacggtaatagaactcaacaagctgctttaacttatggtactaaatataatcgtgaaatgtattgggatggtacagattctgatggtaatcttgtaaaagaaggtacttatacttttgaagttcgtgctatacaagaatatgaatatctaaactctgtagactatggtgataaagattcatgtttagatgttttaatgaattctgataatgttcaaacacaatcatttgatgtaaatgtggatgtaactgcaccagaagttgatttagctttaactaatgacaaaattcttactattaatgcaagtgatagatctggtatccaagctttagctgtttattataaagatgctcgtgttagtgatattattcgtgtaaataacactgaagcagatttaactattaatttaaatgatttgattgaaaatatatctgatgattttgatgtaaatgatttagaagttcaagttgtagattatggtatgaatattgctgaagcttctgctacaactgctgataagactgctttacaaattgcaatagatttagctaatgcaatcactgatgaagatttagaaaatgttgtaccagcagtagttgatgaatttaaagctgctagagatgaagctaatgcagtttataatgatttaacagcttcacaagaagaagtaaataatgcatttgatcgacttgcaaattctatgcatatgttagactttgaaaaaggtgataaaacagcattaaaagcatttatcgataaagttagtggattagaagctgataaatatacagaagctacatggacagcatttgaaacagagttaactgaagcagtagctgtatataatgatgaaaatgcaatgcaagaagaagtaaataatgcatacagtgaattagtaacatcattcttgaatttaagattaattccagataagagtttattagaagaattaatcaacaaagcagaaggattaaatttagctagctatagtaaagcaacagttcaaattgtaaatgatgctttagaaaatgctaaaaacgtattaacaaataaaaatgcaactcaaaaagaagtagacaatgctaaagctacattagaaaaagcgatcaatagcttagaagctaatgtaaatacaccagcagataacacagtaagtacaccagtaaataatggtgatacaactacaagtgtaaaaactggagatgaaagcttagtaggaatgtttacaagtttaggattattggcttcattaggtgcaattgcttgtcttaaaaaaagaaaaaataattaa

SEQ ID NO: 2456 - DNA, 1929 bp, Unknown
  Artificiall/Consensus sequence
atgaaaaatgaaaaagattattatcttacaacagctattacatatacttcaggaaaaccacatattggaaatacctatgaaattattttagctgatgcaattgcaagatttaaaagacaagaaggatataatgtttattttcaaactggtacagatgaacatggtcaaaaaattgaattaaaagctaaagaagctggaattccaccacaacagtttgtagatgaaaaagcagctgaagttaaaagaatatgggatttaatggatacaacatatgatcgttttatgagaactacagatgagtatcataaaaaacaagttcaaaagatatttaaaaaattatatgatcaaggtgatatatatctaggacactatgaaggtaaatattgtacagcttgtgaatcattttttacagaatcacaattagttgatggtaaatgtccagattgtggtggacctgtaaatgatgcaaaagaagaagcatatttctttaaattatcaaaatatgcagatcgtctgattgaacatattgaaaaacatccagaatttattcaaccagtatcacgtaaaaatgaaatgatgaataatttcttaaaacctggtttacaagatctatgcgtatcaagaacatcgtttacttggtcaattccagtagactttgatccaaaacatgttgtatatgtatggatagatgcattaactaattatattactggtttaggatatgatgtagatggtaatcatggagaattatataaaaaatattggccagcagatttacatttaattggtaaagatatagtgcgttttcacacaatttattggccaattatgttaatggctttagatattccattaccaaaacaagtatttggacatccttggttattacaaggtgaaagtaaaatgtctaaatcaaaaggtaatgtaatttatgcagatgatttagttgatatttttggagtagatgcagttagatattatgtattacatgaaattccatatgataatgatggaagtattacatgggatttattgattgaaaaaataaattctgatttagcaaatgtattaggtaatttagtaaatagaacaatttctatgtctaataaatattttgatggaatagttaataatccaaaagtatatgaaccagtggatgaagaattaattaatactgcattagaaatgccaaaaaaagtaataaataaaatggatgattttaaatcatcagatgcattggatgcaatttttacattacttagaagaactaataaatatattgatgaaacaatgccatgggcattagctaaagatgaaagtaaaaaagatcgtttagcaacagttttatataatttaattgaaagtattcgttttagtgctatcgcattaataccatttataccttcaactgcaaataaaattttagatcaaataaatacagatcaaagagattaccaaacattaaatgaattcggtgcatataaagaaggaacaaaagttacagaaaaaccagaaattttatttgcacgtttagattcaaaagaaattgaaaagaaagttgcaaaactatctactgtacaagaagtaaaaaaagaagtaaaggaagatgatttaattacaattgaagattttaaaaaagttgaattagttgttggaacggtagaggaatgtaaaaaacatcctgatgctgataaattactggtatcaaaaattaatttaggtaaagaaacaagacagatagttagcggaattgcagattactatagtccagaagaatttgtaggtaaaaaagtaattgttgttgctaacttaaaacctgctaagttaagaggagtagaatcacaaggaatggttttagcaggcgaaaccaaagatttactagaagtaattaatgtagaaaatttacctaatggtactaaaattcgttaa

SEQ ID NO: 2457 - DNA, 2823 bp, Unknown
  Artificiall/Consensus sequence
atgaaaaatgataaactagttattaaaggggctagagaaaataatttaaagaatataaatattgaaatacctaaaaataaacttgtaattatgaccggattatctggttctgggaaaacttctttggcatttaatactatttatgctgaaggacaacgtcgttatgttgaatcattaagtgcttatgcaagacagtttttaggaaatatggaaaaacctgatgttgatagtatcgaagggctttctccagcgatagcaatcgatcaaaaaacaacatctaataatccccgttcaacagttggaacggttactgagatatttgattatttaagattgttgtatgcaagaattggtaaggcatattgtccagagcataatacggttattgaatcgcaaacgattaaacaaatggcggatattattgatcaatatccagatggtagtaagttacaagtactagcacgagttgtaaagaatcaaaaaggaacgtttaaggatttatttgaggatttattaaaagatggttatattagagttcaagttgatggtgaagttagattattagatgaaggaattgagcttgataaaaataagaagcataatattgatgtagttattgatcgaattatcaaaaaagaaggatatcgtagtcgtttgattgattctttggaagttgggcttaaattaactggtggtgaagttattgttgctaatttaagtgatggtagtgaaaagttgttttctgagcatttagcttgtccaatttgtggttttagtgttcctaaattagaaccacgtctgttttcttttaataatccattaggagcttgtcatgattgtcggggtttaggtgttaaaaatgaagttgatgttgatttattgattcctgattggaatttgagtattaatcaagggggaattagatattttaaaacatcagtaggtacggatcgaattgaatggcaaagatttttgatcttgtgtaaaacatataagatagatttagataaaccgttaaaagatttttctaaaaaagaattgaaaataattttagaaggttctaataaacccataacatatgaaattatatctagtagtggaaatgtttctaaaacaactaaaccaattgaaggagtaaaaactttaattgaaagaagatttgaagaaacaacttcatcttggtctaaagaatggtatgcttcatttatggcagaacatacttgtcctacatgtaagggaagaagattaaatgatcaagttttaagtgtacgagttggaggattaaatattagtgaatttactgatatgtcaattcaaaaagcattagaatttgttgaagaattaaaattgaacgaatatgaaagtaaaattgctcatttagttttaaaagaaattaaagatcgtttaggatttttaaatgatgtaggattaggatatttaacactatcaagaaaagccggaggattatctggtggagaagctcaacgtattcgtttagcgacacaaattggctcaagattaaccggtgttttatatgtattagatgaaccttcaattgggttacatcaacgtgataatgataaattgattgcgactttacaaaatattcgcgatttaggtaatagtgttttagttgttgaacatgatgaagatacaatgcgtgcaagtgattttattgttgatattggccctggtgctggtgtccatggtggtaaggtcattgttgctggaacgcctgaagaagtaatggcatgtaaagaatcaattacaggacaatatttatcaggacgattaaaaatagatgttcctaaaaaacgtcgtaaaggaaacggcaattatatttggatcaaaggagctaaagaaaataatttaaaaaatataaatgtaaaattcccacttggctgtatgtgcgttgttacaggggtttctggtagtggaaagagtactttagtaaatgaaattatgggtaaagcaatgatggcaaaaatctatcattctaaagaaaaacctggtaaacataaagaaatattaggtttagaaaatattgataaagttattgaagttagccaagatccaattggaagaacgccacgttctaatccggttacatatactggagtatttgatgatattcgtgatttgtttgcacaaactaatgaggctaaaatgcgtggttatgataaaggtcgttttagttttaatgttaaaggtggccgttgtgaagcgtgtcaaggtgatggtctaaaacgtatttcaatgcattttttacctgatgtctatgttccatgtcaagaatgtggtggaaaaagatataatgaagaaactttacaagtaacatataaagataaaaatatatatgatgttttagaaatgacgatagaagaagcggtagaattctttgataatttaccgagaataaaaaataaattacaaactttaaaagatgttggtttaggttatattaaattaggacaaagtgcgactactctttctggaggagaagctcaaagagttaaattagctagtgaattgcaaaaaaaggcaactggtaaaacagtatacattttagatgaaccaacaacgggattacatagtgatgatgtatcgagattgattacagttttacagcgaattgtagaacaaggagatacagttataattattgaacataatttagatgtaattaaagtagctgattatattattgatttagggcctgaaggtggcgatggtggtggaaaagtcgttgtatcaggaacacctgaaaaagttgcggcttgtaaagaaagctatacaggaagttttttaagaaagatgttgtag

SEQ ID NO: 2458 - DNA, 1761 bp, Unknown
  Artificiall/Consensus sequence
atgagtaaaataatcggaatagatttaggtacaactaatagttgtatggcatatatggaaaatggaaaagcagttattattccaaatgctgaaggaaacaaaacaaccccaagtattgttgcttttactaatgatggaaaacgattagtaggtgaaaatgctaaaagacaagcagtaactaatcctaataatacgattgcttctatcaaacgtgaaatgggaacaaattatcgtaaaaaaattaataataaagaatacacgccacaagaaatatcagcaatgattttacaaaaattgaaaattgatgctgaagcatacttacaagaaaaaataactgaagctgttataactgtacctgcttattttaatgatgctcaacgtcaagcaactaaagatgctggaagaattgcaggacttaatgttaaaagaattattaatgaaccaactgcagctgctttagcctatggattagaaaatagttatgggcaaaaagttatggtatttgatttaggtggaggaactttcgatgtttcaataatagaaattggaaatggtgtaattgaagttctttctacttcaggtgataatcatcttggaggagatgattttaatgattgtattgctaaatatattgttgatgaattcaaaagaattgaaggaattgatttaagttatgatcaagtggctatgcaaagaattaaagaagctggtgaaaaagccaaaatagaattatctacaatggttacaacagttgttaatttaccatttattactaatactaatagtggcccaaaaaatttagaaatagaaataacacgtgctaaatttaatgatttaactagatatttagttgatcgtttagttttaccaatgcaaaatgcattaaatgatgctagattaacgcctgctgaattaaataaaattattttagtaggaggttcttcgagaattccagctgtgcaggataagatcaaagaaataacaggaaaagaagcaagtaaatctttaaacccagatgaatgtgtagcattaggagctagtatacaaggtggaaagttgtcaggagatgttagtactacaggtaattttgatgtattgttgttagatgtaacaccattgactttatcaattgaaacagtaggtggggtagcaacacctttgattgaacgtaatacaacaataccaactagtcattctcaaatctttacaacttcagcaaattttcaaacacaagtagagatcaatgtattacaaggagaaagaccccttgctaaagataataaaagtttaggtaaatttaaattaaagaaaataaaaagagcgatgcgaggtgttcctcaaatagaagtaacgtttgatattgatgctaatggaatagttaatgtttcagctaaagatttagccagtggaaacatgcaaagtattacaattgaaaatacttcaaatatgtcagatgcagatattgaaagagcaattcgtgaagcaaaacaatatgaatcacaagatgcaattactaaagaaagattagtatttaaaaatgaagcagaaaatttagtgatttcaattgaagcagctttagctaaaaatggaaaacaacttgataaagcaactaaatctaatattaaaaacgagcttgcaagctttaaaaaattaactaaaaaagttgattatgaaacatgtgatcaagctaaatttgatgaaataaaatcagcgaagattgatttagaatcgctagcagctacattattatcaatgcaataa

SEQ ID NO: 2459 - DNA, 2079 bp, Unknown
  Artificiall/Consensus sequence
atggtcattggaatatgtaaaacccctacaatggctataagtgaagttacagcatcaggaacacaaaaagcgtatattgttggtgatgactggggaccagcagtaacaaaaacagtaatcgaattagataaagcgattgacagtagctcagtcagtaaagaaaaattcaatgtagtagaagaaaaacaatcttatacaaatcaaccagtagctagaacagtgacagatgcatatacatctgatgctaatggtaataaggttgaaagcagttcaaactatattacaattgaaatgtatgtttcaccaagtgaaggatcaccattcttctataatttcatgagcggaagaaatgtatggtgcgaaacatataaattaaatgtatcattagtagatggtatgacattgacagccggagaagaagtgataaatgcattagcggttgaagcagatatcaatgtatcagatccagctgaaagaatctgtccacagttagatgattttgatacaacaaaaacatatactgcaacagatggaacaacatattcatatgcagaatacttaccggcagaagataatcagaaaaatgcattagtaatctggttacatggagcaggagaaggtggagtagatccaacaatcgatttacttgcaaatgaagtaacagcattagcaggagatgaattccaagaattatttaaaggagcatatgtattagcaccacaatcaccaacaatgtggatggatgatggtacaggagcttatcaaaatggagacaagggatcatgctatgcagaaagcctatttgaattgatagaaacatatgtaaaatcaaatgaagatatcgatacaaatcgtataatcatcggaggatgttcaaacggtggatatatgacaatggaaatgattttaaaacatccagattattttgcggcagcatatccaatttgtgaagcattccaagatcaatatataagcgatgaacaaatagaatcaatcaaagatatgccaatctggtttacatatgcaaaaacagatagaacagtaaatccagaattatgtacagaagcaacagtagcaagattaatagaagcaggagcaaaaaatgtacatgtatcagcatttgaagatgtacatgacacaacaggaagatttacgaatgcagatggaacaccatatacatatgatggacactggtcatgggtatactttgataacaacgaatgctatgatgaaaatggagtaaatgcatggcaatggcttgcaaaacaaaataaagtgagtggagaagttgtagacaaaacagcattaaaaattgcagtagatctagctaatgcaattactgatgaagatttagctaatgttgtacaagcagtagctgatgaattcaaaatggcaagagatgaagctaatgcagtatataataatgttagtgctactcaagaagaagtaaataatgcatttgataggcttgctaacgctatgcatatgttagactttaaacaaggcgataaaacagcattaaaagcatttatcgataaagttagcggattagaagctgctaaatatacagaagctacatggacagtatttgaaacagaattaaatgaagcagtagcagtatatgaagatttaaatgcaatgcaagaagaagtaaacacagcttacagtgaattagtaacagcattcttgaacttaagattaattccagataagagcttattagaagaattaatcaataaggcagaaggattaaacggagtaaactatacaaaagcatcatatgctgtagtagaaaatgctttattaacagcaaaagcagtatatgaaaatccaaatgcaacacaagaagaagtagacaatgcaaaagctacattagaaaaagcaatagccggattacaagcaaatccaagtacaccatcaaatgtagaaaatacagtaaaaacaccagtaaataatggtgatactacaagtgtaaaaacaggtgatgatgttaatatgttaggaacattagcagggcttgcgttattaagtattgtaggagctaaagttcttagaaaaaaagaagattcatgtaattaa

SEQ ID NO: 2460 - DNA, 2790 bp, Unknown
  Artificiall/Consensus sequence
gtggtaccgcgaatattcgtcctttgttgggacgtttttttattttatggaggtaagaagatgaattacaaagacacattattaatgccaaagactgactttgagatgcgaggaaatcttcctaaaaaagaaccaggttatgtaagtcgttggcaagagacaaacatgtatgaaaaagttattaaacaaaatgaaggtaaggatagttttgtttttcatgatggtccaccatatgcaaatggaaatatgcatatgggacatatgttaaacaaagttattaaagacgttatttgtcgatacaataatatggaagggcgttatacaccatttattccaggatgggatactcatggactcccaattgaaaatgcaattcaaaaattaggtgtaaatcgtaaagaaatgtcaactgcggcatttagagagaaatgtgatgcttatgctcatgaacaagtaaataagcaaatggaacaattaattagaatgggaacatttgctgattataaacatccatatttaacattattgcctgaatttgaagcaaatcaaattgatgtatttgcaaaaatggcaatggatggtttgatttttaaaggattaaaaccagtttattggtcgccatcaagtgaatcagctttagctgaagcagaaattgaatatcatgatattaaaagtccaactatttttgttaagttccaagtaaaagatggtaagggtattttagataatgatacatattttgttatctggacaacaacaccttggacaattcctgctaaccttgcaatctgtttgaatgaaacatatgactatgcattagttgaaacaaataaagggaaattgattgttttagaagagttagttgattcattgatggaaaaatttgaaattgatgaatatcaagtaagtaatcatttcaaaggaaaagaattagagatgattacttgtaaacatccattatatgatcgtgaatcattagttattttaggtgatcatgttactgctgaagctggaactgggtgcgttcatacagcacctggatttggggcagatgacttttatgttggtcaaaaatatggtttaccagcatattgtaatgtagatgaacatggttgtatgatgaaagactgtggtgaatggttagaaggacaatatgttgatgatgctaataagacagtaacaatgaaactagatgagctaggagtattattgaaattagaatttattactcatagttatcctcatgattggcgtactaaaaaaccaattatttttagagcaactgatcaatggttctgttcattagataaaattagagataaattattagcagaaatcgatagtgttaattggttaaatgaatggggtcatattcgtatttataatatgattaaagaacgtggtgactggtgtatttcacgtcaaagatcttggggtgtaccaattccaattatctattgtgaagatggaactccaattatggaagaaaaagtatttaaacatatttctgatttatttagaaaacatggttcaaatgtttggtttgaattagatgaaaaagatttattacctgaaggctatacaaatgaacattcacctaacggtatctttaaaaaagaaaaagatattatggatgtttggtttgattcaggatcaagtcatactgggtgtatgaaagaacgtggttatccatatcctgtagatttatattttgaaggtagtgatcaatatcgtggatggttcaattcatctttaattataggtaccgcagctcatggcaaagcaccatataaaacagtgttatcacatggatttgttttagatggtaaaggtaataagatgtctaaatcattaggaaatacagttgatccaattaagttggtaaatcagtatggagctgatattgtaagattgtgggcaacttcagtagcataccaacaagatgttcgtattagtgatgaaatcatgaaacaaatttctgaaaactatcgtaaaattagaaatacaatgcgttttgttttagggaatttaaatgattttaaacaaagtgatttagttgctgttaatgatttaactgatgttgataagtatatgttagttgagttaaataatttaattgatggatatcatcaagcatatgataattatgattttgctgatgcaaatcaacaaattttaaattattttactaatgtattaagttctttctatatggattttacaaaagatattttatatattgaaaaagctgatagtttacgtcgtagacaagtgcaaactgtattatattatcatgctaaagcaatgatgaaattaatttctccagtgttagtatttacagccgaagaattgcatgatcatttccactgtgatgaaaataaagctgaatctattttcttagaaccaaatgttgaaaaggttgtaattgaaaatagtgatgaaattaaatcatattttgatcgtttcttattgttacgtaaagatgtattaaaagtgttagaaactttaagaaatgataaagtaattaaatctaatatggaagctaaagtatttatttctttaaaagatgaatttaaagatatggctaaattagctgatgatttaaaacaattatttattgttgcaaaagttgaattagtggaaaataattcattagaagaatttgatagtgcttatattaaagctgaaaaattcaatggtcatcaatgcccacgttgctggaattattttgatgaagatgaaatgaatggcgaagtatgttgccgttgtcatgatgtaattaatggttaa

SEQ ID NO: 2461 - DNA, 3372 bp, Unknown
  Artificiall/Consensus sequence
atgaataataaaaagattaaaacagcgttggtagcagcaatgttaacatcaactatggcttataatataccagcaattaatgctactacgttaactcaaaaaagtgttgataatccagttttagtaccaacacctaagaaagtaacttatgaagaaaatattcttgctataactaattcggttaatattaaaggaaaagatgtagctgatgcagatgcagttagagaattaactgaatttttagaaagtaattcaattactgtaaatgatgattatcaagaaggatctactactattattatcggtgaagaagatgatgaagtagatggtttagatgcaactagagataatttaggattggtagatgcagatactttagatgatgaagggtatgtattagctgttgatagcgataataatggaactgtattaatcgaaggtaaagatggtgatggaacattctatggggttcaaacattgacacaattagcagttaatgatgaaggagttttaaaatcaaaagaagctaaaattgaagatgaacctacaatgacaactagaggatctattgaaggtttctatggtaacccatggtctcatcaagatagattaaatcaaattgaattttatggtaaatcaaaattaaatacatatatctatgctccaaaagatgatgtatatcatcgtgaaaaatggcgtgatccttatccagaaaatgaaatgggacgcatgaatgagttgattgaaacttctaaacaaaataaagttgattttgtatttgcactttctccaggtattgatattcaattaacaggtgaaaatgcagaagcggattatcaagctttagttaataaatgtcaagcaatgtatgatatgggagttagaagttttgctattttcttcgatgatattgcaaataaacaaggaacagaacaagcaaatttattaaatcgttttaataaagaatttattcaagctaaaggtgatattacaccattaattactgttccaactgaatatgatacaaatgcaatgagtaatggaactgaattaaatacttatactaagaattttagtgaaacattagattcaagtattaaagtattatggacaggaactgcagtggtacctgaaggaattgatattgctaatgctgaatttattaaaagtatttatggtgaacgtgtaggtatttggtggaattatccagttactgattatattactgataaattaggattgggaccagtttatggattagataaaggattagctaatgaattagatttcttagtaatgaatccaatggaacatgctgatttatcaaaaataactttatctactggtgctgattattcatggaatactgaagcgtatgattatgataaatcatttaaagatagtattacaaatatatatggtgatttagcaccatatatgtatacttttgctaaccattctacaagattggtagcaggatgggcttctactggtagagccgatgcgccagaagtaagagcattaatggatgaatttattaagaaaaatgcaaaaggtcaagatgctagcgcagaaatcgaagcattgactactgaatttgataatatgattcttgctgcagataaattacaagaattattgccagctgatcaattaagtcattgtgatgcaaatttaaataaattaagaagtttaggtgaaaatgataaactagctttagagttatttattgcttatagtgaaggtgatagtgaaagcattgattcgttaaagagtacattaaatgcaaatttaccatcattaaaagcaggtaaaaaagtatctgaattaactgcgttagaatttattaatgaagcagttaactataatccaaatgctgttgcaggatttgaagtttcaagtacttttgttactccagggcaagaaattcaattaactaacacaagttctgtttcttcaactgatttaaaatggacttttgaaggtgcaaatattgaaacaagtactgaagaaaatccagtaattagttatgataaagaaggggtttatacaatctcattaaaagctaaaaataaattaggagaagatgaagaggtaaaaacaggaattataactgtttctaatgaagcaaataatgaaatagttaacttatcaaaaggaaaaacagctacagcatcaagttatacagcagcttctgaagcaccggaaaaagcaattgatggtattacatcaacaaaatggtgtgcaacaggttataacagaccacatacattatatattgatttagaacaagaaatgacagttacaaatgtaacaatttcacatgcagaaattggtggagaaggttctggattgaatacccgtgattatcgtatcgaagtaagtaaagatggtaatgaatatgttgaagttgcaaatgtaaaagaaaatgttgcaggattaactagcgataatgttccagtaagtattgcaagatatgttaaattaattgttgatacaccaacacaaggtggagattcagcagcaagaatttatgaagttgaagtaaatggtttagaaaaagctattactcttccaccagtttatgttgaagaagctgaaaaaacagcattaaagattgcagtagatttagctaatgcaattactgatgaagatttagctaatgttgtaccagcagtagctgatgaattcattgcagcaagagatgaagctaatactatctacaatgatgctagtgcaactcaagaacaagtaaataatgcatttgatagacttgctagtgcaatgcatatgttagactttaaacaaggcgataaaacagcattaaaagcattcatcgataaagtcagcggattagaagctgataagtatactgaggatacatggacagcatttgaaacagaattaaatgaagcaattgctgtatacgaagatttaaatgcaattcaagaagaagtaaacaatgcatacagtgaattagtaacagcattcttgaacttaagattaattccagataagagcttattagaagaattaatcaataaggcagaaggattaaacggagtaaactatacaaaagcatcatatgctgtagtagaaaatgctttattaacagcaaaagcagtatttgataatccaaatgccactcaaaaagaagtagataatgcaaaagcaacattagaaaaagcaatagccggattacaagcaaatccaagtacaccatcaaatgtagagaatacagtaagtacaccagtaaataatggtgatactacaagtgtaaaaacaggagatgatattaatatgttaggaacacttggattaatttcatcattaagtgttattacatttcttaaaaagaaaagaaaaaaatag

SEQ ID NO: 2462 - DNA, 3495 bp, Unknown
  Artificiall/Consensus sequence
gtgcaagaatatgcacacaaaaaggagagaaagaatatgaaattagggaagaaaattgtttctttgatgatagttttagtgatgattgctacaactatatttgggataaatatttctaatgctgtggctttaactaatgaacaaaaagctcaagaattagtttcaaaaatgacattagaagaaaagataggtcaaaaaatcatgctttcatttagaagtgggtggacaatgaaagatggtacaaaaatttcatctgtacaaaatattaatgatgaaatttatgaaattattggaaaatatgatattggaagtgttattttgtttgctgcaaattttgcgtctgatgctagtatcaatgttgaattgacagatggattacaaaaggcagcaattgatccaaatttaggagaaaataatattcctttaattattgcaacagatcaagaaggggggatagtttatcgattgacgggaggaactgctttgccaggaaatatggctgtaggagctacaaatgatccagaaaatgcatttaaagctggaaaagttattggtagtgaattaagtgcagtaggtgtaaatacaaattttgctcctgatgcagatgtcaataataatcctaataatccagttattggattacgttcatttagtagtagtccacaattggcagcaaagtttactacagcttatattgaaggagttcaaagtcaaaacatagctactactgctaaacattttccaggacatggaaacgttgcaactgattctcatactggcttaccttcaattgatgctactaaggatgagttatatcaaacagaattagtaccattccaagcagcaattgttgcagggactgatatgattatgacagcacatattcaattcccaaatgttgttgaggaaaaaatatattcatcaaaacaagatgaacatatgtcaccacctgctactttatcaagagaaattttaactgatttattaagaaatgaattgaattttgatggtgtgattgtaactgattcaatgactatgaatggtgttgctaattattttgatgtaaatgaacgtaatttgctagcagtcaaagcaggagttgatattttagatattccatttaatgatatatcttcatgggctgatatggaaactaaactaattccgttaattgatgcatttgttgatgcctatactaaagaagatggttataatggaataaaattatctattgaggaattagataagtctgttgaaagaattttaacattaaaatataatcgtaatattatggaattagttaatgataatacgagtttacaagataaaaaagcaaaagctttagaggtagtagggtcagttgaaaatcgtgaaacagaaagattgatttcagcaaaaggagttactgttgttaaaaatgaaaatgatgttttaccattgaaattaactagtaattctaaagtattatttgcaactacatattctagaaataataatcgatttgttttagcgtgggaaagagcaaaacaagctggaattattccagaaggtgcagactataaaattttacaacactataattggactggattagatgataaagtcaacagtgcaattaattcagatggttcaaatttccaaggaacaaatcgtgatttattagattggtgtgatgtattagtacattcttcagaaatatctagtgcctcaggaatagatggttatcttgttgcatgtccacaattatttactaattattgtaagagtttaggaaaacaaacagttgtaatttctttaaatcatccttatgatgtccaagcatttcctgatgctgatggaattttagctgtatatggaacaactagtcttggtttggatataactgaatcttttggaggaggaacagtaggagcgactgctgcatttagtccaaatcttactgctggaactgaagtagttttaggtacatttggagcttctggaaagttaccggttgatatacctaaatatgttccaggatcaaaagtatattcaacagatgaaattgtttatgaactaggttatggtattgaatatgaagcattagctaaagatcctgataaaactgctttagtagaagcaatcaataaagttgagacattaaataaaaataattatactgaagaatcatggcaaagtgccaaaaatgaattaaaaacattaaatgatgttttaaaagttgctaaaaatgctaatttaactcataaattagcgcaagcaaaagttgatgaaaatacacaagaactaaaaaatcaatatgataaagttttagaattattagtacctgtcagtgttgataaaacagcattaaagatagcagttgatatggctaatttaattacagatgaggaattagaaaatgttgtaccagtagtagttaatgaattcattgtggcaagaaatgaagctaatgatatttataataatgcaagtgctttacaagttgaagtaaataatgcatttgacagacttgctagtatcatgcaaaaattagaattttacaaaggtgataaaacagcattacaggcatttgttgataaagttgataaaatagattcaagtaactatactccaattacatggacggtttttgaaacagaattaaatgaagcaaaagatgtattagctaatgaaaatgccatgcaagaagaaataaataatgcatatagtgaattagtaacggcattcttgaatttaagattaaaacctgataaaacaggattaggacaattaattgaagaagctgaaactaaacaagaaagtaattatacacctgaatcttggaatgctttacaagaagcattaaactatgcaaaagaaatttataatgatgaaaatgtaacacaagaagaggtagataatgcagtaactaaattacaagatgcacttgataatttggtgagtgtagtagataaaagtgcattacaagcaatggttgataaagttaatggattagacagtaaattatatacagaagcatcatggaataatttagctgaaccaatgactaatgctcaaacagtattagataatctagatgcaacacaagttggagtaaatgcagcttatgaagcattaataaaagcatatttaaacttaagattaattccaaataaagatttattagaagaactaatcaatcaagcagaaattttaaatgttgctaattatacaaaaacatcatacactgtattaaaagatgcattaaatgaggcaaaattagtattagataatccaaatgcatcacaagttgaagtagatgcaacaaaagatgttcttgcaaaagcaatcgcaggattacaaatagtagacaacatagtaagtacaccagtaaataatggtgataccacaagtgtaaaaactggagataataatttagctgaaatatttgcaggactaggattattaagtatggctggatatattgtatttagaaaaaagaaaatgattaaatag

SEQ ID NO: 2463 - DNA, 1884 bp, Unknown
  Artificiall/Consensus sequence
atgaaaaaatttataaaaataatcttaactattttaactatcatgacaacttcacttttatcattatatgttattgcatacttaataggttctccagatttaaataaaaatagatatctaaaactatatgataacaatcaacaaatttattatcagtcaatcaatgattatgctggtcactatgtttctttggataatgtcagtcaatatttcaaagacagtatcgtagctatcgaagatcgtcgcttctatcaacaccgtggttttgatcctattggtattttaagagctataaaagtaaatatcacaaatcaagataaatcacaaggggctagtacaataactcaacaatatgctcgtttactgtacttaacaaacgaaaaatcttggtctcgtaaaataaaagaagcttttttaaccatgcaacttgaaacccatttaagtaaagatttgattcttgaaggttatataaataacgtatattttggtcatggtatttatggtatcgaaaatgccgcacgctatttttacgataaaagcgccaaagatttaaatttaaacgagagctctatgcttgctggaatagttaatggacctacttatttttcaccactaaatgatgaagaaagcgccagaaaaagacaaggtgtcgttttagatgctttaattgataccaaaaaaatcactaaacaacaaaaacaggaagttttaaatagtcctttaaatctagcaagtgaacataaagttgatgaaaatctatcaaataatttctataaagataccgttattgatgaattagaagagctaggatattataataatacttacttaaatcaaggtttaaatgtatatacaacattagatcctgactatcaaaaagtattagaacaaagcgctactaattatacaaaagacagcgaagtagaaacatcaagtattgtcgttgaaccttacactagtaaagttttaggattaataggcggtaaagattattcaaaatcacagttcaatcgagcaactaaagcaaatcgtcaaattggaagtactatcaaaccattattatattatttagcattagaaaatggttttagtcctacaacaacttttttaaacgaacctacaacttttaaattagaagacaatacaacttatagccctggtaatttcaatgataaatacgcatataaagaaatcaatcttgctcaagcaattgcagtatctgataacatatatgcagtaaaaacacatctttttcttggcaaagaaaaccttgcttctttaattaaaaaatttggtattgaagatgtagaagcaaatgcttctcttgcattaggaacattaaatactaatatttataatcttgctaatatgtataatacacttgcaagtgaaggagtatataatcatctatatactattgaaaaaatcactaataatgaaggtaaaattatttatcaacataaagcacaaaataaacaaatgttgaataaagatagttgcttggctctatcacaattattaaccgcttcttttgataatcgatatagcacttatttacaagctactatggctgcatataaactagaaaatactaatgcctgtaaaactggaagtactgactttgataatttagctgtagcgtataatcctaatgttttagtagctagttgggttggttatgatgataatcgaaaaatgaaaacatcaaatgataaaactgtagcaaaaaaaaaagttgtagatgtattgaattacactaatgaaactcaagatgttaaatggtataaacctactaaaaatcttcaagcaatcgctattgatccaattagcagtgaatttgacgaaaatggtatagtatattggttcaagaaaaaacaatcctga

SEQ ID NO: 2464 - DNA, 6192 bp, Unknown
  Artificiall/Consensus sequence
atgcagtacattaaaaagatatttattactattattgccgtttttgtaacagtatctactattacaagtaacgttgtgataacaaatgcattagatgatgttaatgaatatgcaattatgcgagaaaagtttcatgacatggctgttggtggtgattatgatattaatgatcctgttgttcaaccgatgttacagtcaatcaatgatacagctcaaatgtattgggataatatgaataaaaatcctgtttctaatgcaaaaaatggaagttatatgaatgaagatgacagtgcattggatccaaatttagatccatcaaaagattatattttcccagagtatcctctaggaaaacgtcgcagtggtagtagttcatatattaatgcaaattcgattcagtttacatatcaatatattagagcaatggctttagcatatgaaacaaaaggatgtgcattatatcaaaataaagatatgcttgaagacattaaaatggcattagagtttatgaacaaatatcattataatcaagactttaaacaaggagataaaactgttccttatggtaactggttttcttggcgtttgggggcaccggtatatttaggggaaacattattacttttatatgatgatttagataaagaagtgattaacaaatatgctgcaactatggaagaatttgtaaactggacttcttttacaggtgctaattcaacatggaatgaaagagtaagtatgtatactggtttgttgacagaaaaagaatcatatatgagccatattcaatctgttatgcctacagtattaaagtatactgaaccaggtgatgggtctttccctgatggatattatgaagatggaacatttattcaacatacaacattcccttataatggtggatatggtttaatgtgtttgactgatacggcttatttattatatatgctttcaggaacaaaatgggatcttggtgaagatagtgctaatattgtatatgattgggttatagattcgtatgaaccaatggtatataatgggctaagtatggatgcttttcgtggtagagaaattactagaagtgatacaactcaacctagaggtgcattgattattgccaatgcaatgttaatgttaagtgaaaatgctcctgaaaatattcaagaacaatttaaagggtgtattaaacaatggtttagtaatgattttatgattgaacagatgaatgctagtgcggatacaccatggtataaattccctttagatacagttgttaaggtaaatagtattttaactgatgatagtattacaccaataagttttgatggaacaacttatcagatgaataatggggcacgtacaattcattggtcaaaagaaggatgggcttatacaatcgcaatgtcttctccaacgatcaaaacttatgaaggtggtgattccaataataaaggttggtatattggaaatggtgctacttatttatatacaaatgatttagaacgtactgaaggtgtagaaaaagcaacaaaagattggtatcgtattccaggagctacatcagtatatggaagaaatcaaggcactcaatacaatttaaatccatttgcaggtggcgtaactgatggtgtatatggtgtatctgggatggatctttcaatgacaactcatgatttgaaagcaaaaaaatcttggtttatgtttgatgatgaagttgttgctttaggaagtaatattagtggacaatatgatgtagaaacaacacttgaaaattataaaattgatagtgaaaatagaacttactatgtagatggtaataaacaaactatgactatggatggtacagaaattgcttatgacaatgctaaaacattccatatgagtggaaatgtagaagattcagatattggattttatttcccaaacaacttagatattaatgtaaaaagtgaaactagatcaggaacatggtcttctttaggggaatataatcgtgatactaatacatatagtgctgattattttactgcttggatggatcatagtgaaaatggaaatggtgttaatgatagttcatattcttatgtattattaccagggaaatctgtagatgaaacaactgaatatgctacaaatagtgatattgaaattattcgtcaagatgataaagcacatgctgtttatgaaaagagtttaggcacattaggagtaaatttctggcaaaaaggatatacttcagttgatttaggtgatgttaaaaattatgtaacaagtgatagtcctgcttctgttatgatcaacgatactgataatggcttaaacgtttcagttacagatacaactcaacaaaataaagattatataacactagaaattaaccgtgaagtaagcggaatagttagtagtgacaaagaaatagaagttattcaaatggcacctacaacaattattaaagttaatgttaaagatgctgatggtaaaaatttccaaattaatttttcatatgatgatgtagatttaaaacctacttctattgcaaatgtttctatggatgatgatgctttagtagtagatattaatcgtgaagtaaatgcaaaaagttatttgattcattatggcgttgaaagtggaaaatatacagatgttttagaaactgaagatttaacaacacgaatttatggattaacaccagatactacttattatttaaatgtacaggcaaaaaatggtgaaaatattagtgaatttggtaaagaagtttcttttacaacaacagcaacaacttcattttttgatgaatttgaaacaatggataaaatgttaacacatacatcaaattgggactttgattcaggaaatgccggacaagatggacaaccaaataactttgaaggtgatagcacacgaattaaacgtgttggttcaaataaaaatagtgaagagtcaattgtttatatgcttccaagtcttcaagattttaatttagaagtatatggttatgataattctattggaacaatcaatatatatacatcacaagatggagaaacttggcaaaaacaagaatatcgtaaatcaacgcctgtaaatacaaaaaatggatggtttagacaaaatttattaacaccagatagtggtataaatgaaaatgcaaattatcttaaaattgaagtttgtgatcatccaacaaaagtatgggcaccacaatttactagatttgatgcaacgatgaaaaatacaagtaatcttaaaatgttgaaagattcaatacaaaatgatagtaaaacatatttaactaatgatgttgattatacaacttatctagaagatgatgtagtaaaagcaacaagtgataatggggaattattatatagttatacaaatattaaagaaggaacaattatcgcttatgttaaagatggtggaaaaattgatgttcttacatcaaaagatggtttgacttatcagccattaacagtttcaaaagaagaaatagaagcaaaagacggatatactaaaataaaaattcatattcctgaattggaagaaaatactgattatttaaaaatagcaatgtcaaaagatagtatgattttagatgttgcattaagttatgttccagaaaatgcagatattcaacaaattcgctttgttgatgaaaaaatcgatggagttattgattatgatactgttccttctattaaagtagctccaatgaatgcacaaagtaaacttgtttatagttcaaataatgatgatattgtttcatttaaagacggtacattacagtttataaaacaaggtacaactacagtagatgtacaagttaaaggaaaagatatatctgcatctttaccaattaatgtatataaagatatggcattaaaaaagacagcaactgcaagttcatcaaaagctggttatggagtaacaaatgctgttgatggtgatgttgatacaacaagatggcaatctaacacagaaggtaaagaatggattcaagtagatttaagaaaagaaacaacatttgatgcaattgatcttagttggtattcaaatggtgaaagttatgatattttaatttctaatgatggaaaaaattggaaaactattaaatcaataacagatgctaagtatggtcaatatgcacgatttgattttgatgaaccaataactgctcgctatgtaaaaatacaaggggtaagtgaagctcaatattcattatttgctttccgtgttttacaaaaaacaggaagcgaagacgaagttgaattagaaccatggaacttagctttaaataaaccagcatatagtagtggattacatccaagtgacggaaatggaaaagcagaaaaatatgccgtagatggaagtattgctacacgctgggcatcaagaagaacaaatgatgaatggttttatgtagatttacaagctgactgtaatatacaagcggttaatatattatgggaaactgcttcagcaaaagagtttaaattacaaatatctaatgatggtaaaacatggactgatatggcgcatataaaaaataatagcgtacaaggagattggacaaatcatacttttagtcaagattatgttggtagatatgtgcgtatgcaaggaattgaagctaatacaaagtatggatattctatttatgaattccaagtaatgggaacaacaattgatgatcctgataatcaagatattaatagtatatcatttgtagatactacaatgagtatgttaaaaggacaaacaactacacttgatattataactgatccagaaaatatcatcccttctagtattggatggaaatcatcagatcctagtttagtaactgttaataacaatggtaaaattacagttaaaggtgaatcaggatttgcaacaattacagcttattcaataaagaatcctgatgttaaagcagagtgtataattaatattactccaaatgctggaaaaataattaaagtaggtgaactatctttaataaatacaattgatacacttgcattaggtgatgttcatcaattaagtgctaaaattactccagaaaatgccacacataaatatattatttggtcaagtagtgatgaaacaattattcaagtcgatgctactggaaaactacaagctgttggaattggagtggcaacaattacagcaaaaacaactgcacaaacaagtgtagatttaacaattacagttaaagaagttaataaagatgctttacaagaagcatatgataacaataaagataaaactagcgaaacttatacaccagcaagttggcaagtatttaatgatgcaatgcaatatgcaaaagcaatattagataatgaaaatgctagtcaaaaagaagtagaccaagcattaacaactttaataactgcagtagaaggattagtaaaaaaagctaataagtttgaattacaaattgcaattgacttagctaatgcaattactgatgaagatttagaaaaagtaattccagtagtagttgatgaattcattgctgcaagaaatgaagctaatgtagtttacaataatgaaaatgcttcacaagttgaagtaaataatgtatttgatagacttgctagtgtaatgcaaaaattagaattcttcaagggtgacaaaacagcgttaaaagcatttattgataaagtaagcgaattagaagctgataaatatactaaggatacatggacagcatttgaaaaagaattaactgaagcaaaagctgtgtataaagatgaaaatgcaatgcaagaagaagtaaataatgcatacaaagaattagtaacagcattcttgaacttaagattaattcctaataaagatttattagaagacttaattaatcaagcagaaggattaaatgctacaaactatacaaaagcaacatttgatggattaacaaaagcattaaatgaagcaaaagtagtatttgaaaatccaaatgcaactcaagaagaagtagataatgcaaaagatgttctagaaaaagcaatcgcagaattacaaacagtatcaactgataatacagtaaaaacaccagtaaataatggtgatagaactgcaagtgtaaaaacaggagatgaaagcttagtaggaatgtttgcaacaattgcattattaagtgtagctggatatacagtgttaaaaagaaaagaagattaa

SEQ ID NO: 2465 - DNA, 2781 bp, Unknown
  Artificiall/Consensus sequence
atgaataaaaataataaatttaatgatcatcaaataatgtatctgacacctgttgaagcttatactttaatgaatagtagtatggaaggtttatcagaagttcaagtaaaagaacgaattgaaaagtatggtaaaaatgaaatagctagtaaaaaagaaacaccgatgattaaaaaattattttcaaattttactagcttaatggcattacttttatggggtagtggtttacttgcaattttgtcaggaactatagagttaggaatatcaattttttgtgtaaatttaattaatggatttttttctttttttcaagaatttaaagctgaaaaggcaaccaatgcattgcaaaaaatgatgccttcatatgctcgtgttgttagaaatggtaaagaagtaaaaattttggcagaagaaattgttcctggtgatataatgattttagaagaaggtgatcgtatttgcggggatgcaagaattttacgttgtagtgattttcaagttgatcaatccactttgacaggagaaagtaatccaattagaaaaaattttgaagctttaaaagaagaagtttcatatcttgaagctgaaaatatgatttttacaggtacaactgttgcttcaggaacatgtcattgtgtcgttgttgctactgggatgaatagtgaatttggaaaaattgctgatttaacacaaaatactgaaaaaacattatcacctttacaaaaggaattgaatgttttaacaaagcaaatagcaattattgctttaagcataggaatagcttttatgttaatcgcaatttttattatcaaagatcctttgttagagtcatttatttttgctttgggtatgatcgttgcctttattcctgaagggttactaccagcagttacattatcattagccttgtcagtacaacgaatggctaaagaaaatgcattagttaaaaaattatctgcggttgaaacattaggatgtactaatgttatatgttctgataaaacaggaacattaactcaaaatgaaatgacggttaatcatttatggacagctgattgtcaaatggatgttagtggtgaagggtatgcaccaataggaaaaatttataatggcaatcaagaaatagatgctaaaaaaagtaatagtttaaatttattgttaagtggtgctgttttatgttcgaatgcaaaattaatcgcacctgaaaaagatagtatcaatggacgctatactgttttaggggatccaactgaggcatgtttagaagttgttgctcgaaaaggaaaaatagatttggataagttaaatagttattatccacgaattttagaattaccatttgaatcaagaagaaagagaatgacaactattcatcagttgaaagaaccatttgaaggtagtcagcgaattgcttttgttaaagggtcaccaaaagaagtaatggaattatgtactcattgttttcaaggaaaagccagagcaattagtgatgaagatcgtataaatattatgaaggctaatgacatgtatgctcgcgaaggtttaagagtattagcagttgcgtatcgaacattaaaacctcatgataaagatttaccaagttcaattagagattatagtccagaagtaattgaaaaagatttaacatttttaggtttaattgcaatgcaagatccacctcgaaaagaagtgaaagaggcagtggaattatgtcacagtgcaggtattaaaatagttatgatcacaggtgattatggattaacagcagaaagtatcgcacgtaaaattggaatcatcagaagtaatgatgcaaaaattatttctggtgtagaattaagtaacatgaatgatgaagagctaaaagaagtgcttaaaggtgaagtcgtttttgctcgaatggcaccagatcaaaaatatcgaattgtttgtgctttacaggaaatgggaaatatagttgctgttactggagatggtgttaatgattcaccagctttaaagaaagcagatattggtgttgctatgggaattactggaactgatgttgctaaagaagctgctgatatgattttaactgatgataattttgcatcaattgtaaaagcgattgaagaaggaagagcagtatataataatattcgaaaattcttacgttatatttttgatagtaatactccagaagcggccgcaccagcattatatttattttcaggtggtttagtgccaatgccacttacaattatgcaaattttgacaattgatattggtactgatatgattcctgcactaggtttaggtgctgaacttccagaagataatattatgaatcaaccacctcgtaaggttaatgaacgtttacttaataaaaaagttattttagtaggttttatatggtatgggttattaattacattatttgctttagggggatatttcttagttaattacttaaatggttggcctcaaaaaccattagcaatggaaggtagtacaatttattataaagcaacaacaatgatgttagttggagttgtatttgctcaaatgggaatggtaatgaataatcgtacggaaagtgaatctgtatttaaacgtggtatttttacaaataaatatattaatttaggattagtcgttgaatttttgatcttgatagcaataatatatattcctatattaaataatgtatttaatacggcaccaattgggatgatcgaatggctttatgcattaccaataccttttgtagtttttgcaattgaagaattaagaaaaaaaata

SEQ ID NO: 2466 - DNA, 1674 bp, Unknown
  Artificiall/Consensus sequence
atgaaatatcaaaagtataagagatttgaaccaatcagttttaaagaacgtacttggcctgataaacagattgaaaaagctccaatatgggtttctgttgatttacgtgatggtaatcaagcattgattacccctatgaaaattgaagaaaaagtagagatgtttcaactcttagttgatatgggatttaaagaaatagaagttggttttccttcttctagtcaaatagaatatgattttctaagaattttaattgaagaaaacttaattcctgatgatgttaccgttcaagtgttaacacaagctagggaacatttgattagaaaaacatttgaatcattaaaagggttaaagcgagcaattgtacatgtttataactctacttctactttacaaagagatgtagtttttcataaaaataaagaagagattaaacaaattgcagttgatggtgtaaaattagttaaagaattaagtaaagaatttgatggggaagtaattcttgaatattcaccagaaagttttaccggaacagaattagattatgctttagaagtatgtgaagcagtaatggacgaatggggagcaaatgaaaataaaaaagtaattattaacttaccatcaacagttgaaatgtcaactccaaatgtttatgcagatcaaatagaatggatgtcaacacattttaaaaatcgtgatcgcgttattttatcacttcatacgcataatgatcgtggatgtggtgttgcagctactgaattaggtattttagcaggtgctgatcgtgtcgaaggaactttatttggtaatggggaaagaacaggaaatcttgatattgtaaatgtagcattgaatatgtttactcaaggagttgatcctaaacttaatataagtaatattaatcatttaaaacatgtttatgaaaaatgtactaaaatggaaattccaccacgacaaccatatgtaggaagtttggtttttacagccttttctggtagtcatcaagatgcaatcaataaaggaatgcatgcaatgcatgaaagaaaaagcgaaatttgggaagtgccttatttaccaattgatccaagtgatttagggcgtcaatatgaaccaattgttcgaattaactcacaatcaggtaaaggtggcgttgcctatgttatggaaagtatgtatggtttccatttaccaaaaggattacaagttgattttgcaaaaataattcaagatattagtgaagaagagggagaagtttctcctgaaagagtgtatgatacatttattgaagagtatgttgataatgaagaaccatatcgtttcattaaacaaaaattaattgatataagtgaagatgacagtgaatatgaaagaagagcagagattacaattgaagatcatggtgaagttgtgactttagttgggtatggaaatggaccgattgatgcggtaaaaaatgccttgaattctctttctgatatgcatactcatttattggattatagtgaacatgctttaacttcaggctctagttcaaaggcagcagcgtatgtttatttaagagctaaaggaagcgcttgccaggaatatggggtaggaatacatccaaatattactactgcaacaattatggcaattatatctggaatgaatcgtttatttcgagtaatgaaataa

SEQ ID NO: 2467 - DNA, 2637 bp, Unknown
  Artificiall/Consensus sequence
atggaggtaaaaatgatgaaaaagcaattagaaccaaagtataatcatcataaagtagaagaaggaaaatatcgtaagtggattgaaaaaaaatattttgaagcaggtgatacaagcaaaaaaccatattctatcgttattcccccacctaatgtaactggtaaattacatttaggtcatgcttgggatactacattacaggatatgatcattcgctataaaagaatgcaaggatatgatgctttatggcttccaggaatggatcatgctggaattgccactcaagcaaaagtagaggctagaatgcaagaagaaggtgtttctcgttatgatttaggaagagaaggattcttaaaaaaagcttggtcttggaaagaagaatatgcctcaattattcgtagtcaatgggaaaaattaggtttatcacttgattattctaaagaacgttttactttagatgaaggattaagtgacgcggttaaagaagtatttgttaaattatataatgaaggattgatttatcaaggtaaaagaatcattaactgggatcctgtgcaacgtacggcattaagtaatattgaagttattcataaagaaattgaaggggcaatgtattatttcaaatataaaattgttgatagtgatgaagaattagtcattgcaacaactcgtcctgaaacaatgtttgccgatcaagcaatttttgttcaccctgatgatacaagatatacgcatttagtaggtaaaaaggcaattaatccagctaatggagaacctttaccaattatggctgatagttatattgatatgtcatttggaacagcagttatgaaatgtacgccagctcatgatcctaatgactttgctttagctaaaaaatataatttagatatgccaatttgtatgaatgatgatggaacaatgaatgaattggcacataaatatcaaggaatggatcgttttgaatgtcgtaaagcgttagttgctgattttgaagctaatggaatcgttgatcatattgaaaaacatatgcatcaagttggacattctgaaagaagtaatgcgattgttgaaccatatttatctaaacaatggtttgtaaaaatgaaacctttagctaagatggctctagataatcaattaaaagattctaaagtaaactttgttccagaacgttttgaaaaaatattcaatcaatggatggaaaatattgaagattggtgtatctctcgtcaattatggtggggtcatcaagtacctgcttggtatcataaagaaacgggagaagtttatgtaggtaaacaacctcctgaagatattgaaaattggaaacaagatgaagatgttttagatacttggttctctagtgcactttggccgttttcaactttaggttggccaaatgaagatagcgagttatttaaacgctatttcccaactaatactttagtaactggttatgatattatctttttctgggtaagtagaatgattttccaatcattacactttactgatcgaagaccatttgaaaatgtattgattcatggtttgattcgtgatgaacaagggcgtaaaatgtctaagtctttaggtaatggtgttgatccaatggatgttattgatgaatatggagctgatacacttagattctttttaacgacaaattcagcaccaggaatggatttacgctatattcctgaaaaactagaatcttcatggaattttattaataaaatttggaacagtgctagatttgttttaatgaatattgatgaatcaatgaagtatgaagatttaacatttgacaatttgaatttatgtgataagtggattttaaatcgcttaaatgaagtgattagagaagtagatattaatatggataaatttgaatttgttaatgttggaacagagttatataaatttatctgggatgatttttgttcttggtatattgaattaactaaagttcatttaaatagtgaaaatgaagttgaaaaacaagctagtttgaatactttagtatatgttttaaatgctattgtaaagatgttacatccatttatgccatttgtaactgaagaaattttccaagcaattccacatcttgaagaatctatttgtattgcttcatggccagaagtaaatgaagattttaatgatgagcaaattaatgatcaatttacatatttaattgatattgttaaaggaattcgtgaaattagaagtcaatatacaattaaaaatgcaattgaagttgcatatattattgatacaaaagatagtcagttagaaggtttaatggatcagtgtttaccatatattaaaaaattatgtaatgcaatttgttcaggttacaatttaaaagcaactggtgaagtagcaaatattacaattaaaggtggtaattctttattaatagaattaggtgattatattgataaagatgctgaaaaagaaaagttacaagctcagttaagtaaacttgaaggagaaattaaacgttgtcaaaatatgttagctaatgaaaaatttgtttctaaagcaccaaaagaaaaagttgaattagaaagaaagaaattagctgattatcaatcaaaatatgacgcagttaaagaaaaattagatacaatgtaa

SEQ ID NO: 2468 - DNA, 3402 bp, Unknown
  Artificiall/Consensus sequence
atgctcttttttgtttttgatatactgcgattgttcaaaggaggaaagagaatgaaaacgaacaattatgttatttcactattaactgcaatgatgattgtttcacaaagtcctgtagttattaatgcaaataatgttaaaaattatcaatatgattcaattggtaatattgttaaacaaaacgaatcattacaagcagatatttttaatgttgattttagtgatggtacaaatgacctatcacctttacaaaatcaattaggaaaaacaattggcaatccaaaaattattgaaagtgatgaattacataaaaatattgctaaatttgatggtagcagtgcttatctttatcctttcaatcaagaaaaatatcaaaaaattaatcaaacagttacgatggaatgcatggttaaatttaatagcattccaagtggtgaacatgatattttttcaaaccaacaatctgggggaatcggtttaggattaaataatggaaaattaactttttttgctcatgttgggggaagttatcgtcaaccggtttctacagttaaagtaggtcagtggtatcatatagttggtgttattgatggtaaagaggttaaattatatgtaaatgggcaattacaaagtacagtaactgccccaagtgcaggaataaaatatccaacatcatcaggggcttggaacatggttttaggtgctgatagtgattcaagtaacggagctcaatcttatattaatgcagatttaagttttgcaagaatttacagtagtgccttaagtgatgatggtattgcttatttaagtgataaagcatttgctggagcagatatcgaagaattaaagccacaagatataaatttaggtttaattggtagtgaaggaattagtgaaaatggacaatggaacttaaatattcatgctaatgaagtaaaagtaggaagtattgataaaattgaatatgatttagtatatgatagtgatgcacttaattatgaaggtgtgcaacataaaatgtctggtgtaacgattttggaagaagaaaaaggacgtttacacattgtttcatctgctacactttcaacaaatgattttaatatttatgcaacaacacgtcttggtaaattaaattttacaacagaagatgtaacagatacaaaaacagtaactatcaaaactgaaaattttaaagcttatgctcaaggtaaagatgttaccgaaagtatgactaattatccacaagcttcaaaagaccttaaaatttatagtcaagaaaaattttatttaaatggagatggggttattggtgctggagatattgctcttgcaagtgatgatttaaaatatgatattgctagtcaagctaatatttatccatataaacatgtggtaattttaactattgatggagcaggaactgtttgggatcctgaatatatgtactatacaacaagtaatagcatacttccaactaaacaaaatagtccggaagttttagctaaacgcaaaaatgtttatgcaatggatcttttgaataaagaatttgcaacaagttatagtgctcaagcagttacgccatctatttcagcacaaaattattcatcaattttacatggagtaccatggaaagatgttccttctgaatatcaagtaactaatgatattgcaggtcaaaaatattatgctgattttaataaagagatagctaaatatccttctatttttaaagcagtaaatagtgcttttccatcacgtcaaaatgcagcatttgctgaatggacacaaattttaaatggaatcattgaaccagatgctcaagttatatcaaaagggtcagcatctaaagaaagtttttatgatgtagctaattatattaaaacggatgattttaaaaatacagctgttgtttatatgcaaagtgactggatggatcatgttggacacagtacaggatattataatgatacatattgggctgaactagaacaatatgatgactattataaagcagtagttgatgctttaaaagaaactggagaatatgatgaaacattaattatcacaaatgctgatcatggtggaaatgcgtataaccatggttctagtgatccttcaaatatggatatttttattggtattggtggtcaaacagttgattctggtaaaaaactgactggtggtaataatgctgatatttcacctattgctttagatgcactaagaattaataaaccaacttcaatgactggagaagtatttgatcaaagtgcatttttatcacaggatgaaatgagtaagaaaaatcgtgatattgaaaatatcaaaatggaagtagctggaaagagtgctacattaacattagagaatccaaaaagtgaaacacgtgtaatcgatgcagtaattgatttgaatggtcaaaatattacatcaattaatcctaatggtggaacaattttacgtcaaagtattgaggatgaccaattaaaacttacaatcagttatacaggacaaccaacaactttagcaacaattaattttgaaaaagagtcaagtacaccagcaaaattatctgaaattatgttaggtgatgaaagtggaaatgaaatctatcctgatattgaaaataatgtaattgcttcactaacaaataaacaacatttacaaattgctgttgaattagctaatcaggtaacagaagaacaactagataaagtagtaccagtagttgttgctgaatttaaagcagcattacaagaagcaaaagaaattttagaaaacaaaaatgctttacaaagtgatattgatgcttcatttgaacgtcttgcaagtgtaatgcaaaaacttgaattttttaaaggaaataaagatatattaaaagcatttattaaacaagtaagtagtttagaagaaaataaatatagtcaaatatcatggttagaatttactaaagcacttaatgaagctaatactctaataaataatgaaaatgctttacaatatgaggtagatgaagcatatactaatttagtaacggcctttttaaacttaagattaattcctaataaagatatgttacaaaatttaattaatcaagctaataactatattcaaacaaattatacagctgcttcatggaatgtatttaaaaatgagttagaaaacgctaaaatagctttaaacaatcatgatgttaatcaacaagaaattgataatgcagtaactgctttaactaatgctatagcaaatttacaaataatcgatacaaaaggtaataaaataaacaacactgatattatatcaagtgtaaaaacaggtgataataatgcaataacaatatttgtaacattaagtttgttaagtacagctggatacattttcttaaagaaaaaaagaaaataa

SEQ ID NO: 2469 - DNA, 1947 bp, Unknown
  Artificiall/Consensus sequence
atgaacagtaagaacggattattaaaatcaattcttccttggctactagtactgattgtaataggtggaatggttacttttatgaatcaaaccacaggtagagaacttaagtacaatgagtttgtagaagtagtgcaagaagaaaaaattaaggaagttgaaattgttccatcatcattagttattgatgtttcaggaagctatactaaaaagaatgatggaaaatcatctgaagtatcatttacaacaactatccctaatacagaagcagagatgcaatcgttgacaagtttattaaacgaaaaagatattgaaactactgttgtagatcctaatgatcgaggaatgtttacaagagtacttttaaatatactaccatatgtactgttattaggtggaatgttttttatttttaaaatgatgtcacaaggtggtggaaatgctaaagcatttgaatttggaaattctagagctaaattagaaaaaaatcaaacaacaagattttctgatgtagcgggagcagatgaagaaaaagaagaattaaaagaattagttgaattcttaaaaaatccaaagaaatttgctcaaatgggtgctagaattcctaaaggggtattacttgtaggtccaccaggtactggtaaaacattacttgcaagagctgtttctggtgaagcgagtgtgccatattattctatttctggttctgaattcgtagaaatgtttgtcggagttggagctggacgtgttcgtgatatgtttaaaaaagctaaacaaacagcaccatgtattattttcattgatgaaattgatgccgtaggacgtcaaagaggtactggaatgggtggcggacatgatgaacgtgaacaaactttgaaccagttgttagttgaaatggatggatttagtggtaatgaaggaattatcattttggcagcaactaaccgtgttgatgtattagatccagcattattacgtccaggacgttttgaccgtcaaattcaagtggctaaccctgataaaaatgcacgtactgaaattttaaaagtacatgcacgaaataaaaaatttgcaccagatgttgattttactaatatcgctcaaagaacaccaggtttttcaggggctgaattggaaaatgttttaaatgaagcagctttattagcggttcgtgaaaatcataaagttatttcaatggatgatattgatgaagcaattgaccgtgttatgggtggaccggcaaagaaatcacgtaaatatagtgaaaaagaacgtcgtttagtagcttatcatgaagctggacatgcagttttaggattagcacttgaagatgctaataaagttcaaaaagttacaattgttcctcgtggacaagcaggtggatataacttaatgacaccaaaagaagaaacttatttccaaacaaagacgcaattagaagctaatattgcaggatttatgggtggtcgtgttgctgaagaaattttctttggtgatgtaagttctggagctcataatgatattgaacaggcaacaagaattgctagaatgatggttacagaattaggtatgtctgaacttggaccaattaaatatgattctgaacaagggaatgtattcttaggtcgtgattatacacaacatagcaattcacattcaggacaaattgcttatgaaattgatgtacaagttcgtaagatcattgatgaatgttatgctaaagctaaagaaattattgaagctaataaagataaattagtcattattgcagatgcattgttagagtatgaaacattagcaggagaacaaattgaagcattatttaataccggtcgtatgttagatcgtcatgatggaacaaatgatgaaaatagtgataattcaaatgataatcaaacaactgtttcatttgataatgcagatgatttattagatgatatgaaataa

SEQ ID NO: 2470 - DNA, 4536 bp, Unknown
  Artificiall/Consensus sequence
atggggatagtggaaaatagaaaggttgagattatggaagatagaaatctaaagatgcaattgctaaatgaacatgatgcttgtggaattggtgcagttgtaaacatagatggaagaaaggattatacagttgttgatcgagctttacaaattgtcgagaaattggaacatcgagcaggaaaagatgctagtggtaaagttggtgatggagtaggaattcttcttcaaatttctcatcatttttttaaaaaagttactgctttacaaaatataaatttaaatgatgaaaataattatggaattgggatgttctttttacctcaagatgaagttaaaaggaatattgcacttaaaatatttgaagatattgtaaaaaataaagaagtaaaatttttgggatggcgtaatgttccttatcatgatgaaatacttggtcaaaaggctaaagagtgtatgccttatataatgcaatgttttgttgaaagacctaaacagattgaaaaagacatcgagtttgaacgcttattatataaaattagacgtgaattcgaacaattaaatctagaaacatatatttgttctttgtcagctaaaacaattgtctataaagggatgtttttagttgaacaattacgattattttatgatgatttacaagatcatgattatcatagtgcaattgctcttgtacattctcgtttttctactaatactacacctagttggcaaagagcacatccaaatcgaatgattgctcataacggggaaattaatactattcatggtaatagtcatcgtatgttagcacgtaaagatattttaaaatctcaattctatgatgatcaatatccgattgttaatattcaaggctcagattctgcaattttagataatgctttagagtatttatatataaatggaatacctttagaaaaagcaataatgctaatgattccagaaccatggaaaaatgaagaaatagctcaagataaaaaagacttttatcactattatgcgacaatgatggaatcttgggatggaccagctgcaattttattttctgatggaaataaaatgggagcaattttagatcgaaatggtttaagaccagctcgttattatatcttagatgatcaaactttaattttatcttcagaagtaggagtattagatattcctgaagaaaaaatcatttgtaaaaatagattagagcctggaaagatgcttttagtagatactataaataaaaaaattattagtgatgaagaatgtaaaaatttatatgctaaaaaacaaccatatggaaaatggctaaattcatatttattgcatttaaaaaacttaacagtacataataaagcatcatatcttgatcaaaatcaaagagatattttatataaagtttttggttatacttatgaagatgttaaagatattattttaccaatggcacaaaacaaaaaagaatcattagcagctatgggaactgatataccattagctatgttaagtaagtgtcatcctcgtttatttcattattttaaacaacaatttgctcaagtaactaatccaccaattgatgcattaagagaagatgttgtagtagatacgactgtatatttaggatcacaaggtaatttattgcaagatcaagctaaaaactgtcaagttttagaaattaataatcctattcttgatcgattagatattgataaaataaaacaattaaatcaagaaggtttttgtagtaaagtaatctcgctatcattttcaaagaaaataacattacaaaaggcattagatgatttgtttgtaaaatgtgacaaagcatatatagatggtgttaatatctttattttatccgatcgagatgttgcttacgatcaactcattattccttcgttacttgcagtttctgctctagaacatcattttatcaatactaaaaaagaaactaatgtatcaattgttttagaaagtggtgaacctcgagatgtgcatcaatttgcatgtttattaggatatggggctaaagcaatttatccatatttagctcatgaatgtatccatgaaatgattcaagaaaatattttagaaaaagaagaaaatcaagcaattgaagattataatcaggcaatagttcatggagttgtaaagattgcatctaaaatgggaatatcaactttacaatcatatcaatcagctcaaatttttgaaacagttggaattaaacaagaagtaattgataaatattttactaatactatcaattgtattggaaaaatcggtttagaagaaatcgaagcagatattcgctattatcataattatgcttacgattcttcaaaactatcaacttttgcttcattaaacagtttaggatttcataaatatcgtaaaggaaaagataaagaaattcatttatataatcctgaaacaatagttatgctccaaagggctactcaaaataatgattatgaattatttaaattatattcaaaacaactaaatcaacaagataaaccatatacaattagacaacttttagattttgatttttcaaaaagaaaagcaatatctatagatgaagtagaaagtattgaatcaattgtaaaaagattcaaaaccggagctatgtcatatggttcaatttcaaaagaagcacatgaatgcatggctattgccatgaataaattaggtggaaaatcaaattctggtgaaggtggtgaagaaatagaacgcctttatggaaaagctaatagtgcaattaaacaagttgctagcggccgttttggagtaactagtgaatatcttgtaagtgcaaaagaaattcaaataaaaatggcacaaggagcaaagccaggtgagggtggacatttaccaggaaaaaaagtctatccttggattgctaaaacacgatattcaacacccggagtatctttaatctcaccaccaccacatcatgatatttattcaattgaagatttagcacaactaatttatgatttaaaaaacgctaatcgtgaggcacgaatttcagttaaattagtttctaaaaatggtgtaggtacagtagcttgtggagtagcaaaagcaggagctgaagttattttaatttcaggatatgatggaggaaccggagcagcaaatcaaagttcaattcaccatgctggattaccttgggaaattggtttattacaaacccatcagacattagtagaaaataatttacgaacacgagtggtattagaaactgatggaaaattaatgacgggtcgtgatgttgcaattgcaacattattaggagctgaggaatttggttttgctactgcaccactagttaccatgggatgtatcatgatgcgagtttgtaatttagatacttgtccagttggcattgcaactcaaaacaaagagcttagaaaaagatttaaaggtaaaccggaatatgtaatgaatttcatgatttttatagctagtgagttacgagaaattatggctagtcttggttttagaacgattgaagaaatggttggtcatcttgattgtttaaaagttaaagataagattggtcaagatattgatttaaaagcaattttaaatcaaaaagcttatcctgttcattttaaaaaacaagatatttatcaatttgaattagaaaataaattagatatgaaagaaatcttaccacgttttaaagatgcattgaatagagggacaaaacatcaagaaacaattcatgtttctagtcttgatcgaagtgttggaacattatttggtagtgaggttactaaaaaatatcagcaaaaactaaacgatgatacttttaccattaattgtatcggtggtgccggtcaatcatttggagcatttttacctaaaggaattacgatgaatttagtgggtgatgccaatgattattttggaaaaggtttatcaggagggcatttagcgatatatcctaattctaaagctaaatataatagtcatgataatgtaattataggaaatgtagctttatatggggcaacatctggtgaggtttatgtaaatggtcttgccggagagcgatttgcggtaagaaattctggagcaattgcaattgtagaagggtgtggagatcatggtttagaatatatgacaggtggaaaagttgtaattcttggtaaaacaggtaaaaatttagcggctggaatgagcggaggaattgcatatgttttagatcaggataacgatttagataaacggttaaataaagaaatggtcttgatggaagaagttactaatagtcaagatcaagcagaattatatgatttgattaataaacactttaaggcaacagcttcatcttttgctaaaacaatcttaaatgactatgcaaattggttgccttgttttaaaaagcttgtaccaaaagattatcaaaaaattatgacaataataaaagaatatgaagatagaggctatccacttgaagtagcaaaacttgaagcgttcaatagaattcacggaataaaggaggaatatcatggctaa

SEQ ID NO: 2471 - DNA, 2442 bp, Unknown
  Artificiall/Consensus sequence
ttgaatataaaccaaaaagtgaaaaaacaaataaggggaaataagatgtttaagactaaagaagaatttaaatatgaattttcgaaaagaattattgaaacttatggaagaacagttgaagaatcgcatattacagaaaagtttttagtattagaattaatggtaagggattatgcttcagttaattgggcaacaagtaaagcattaattagaaacaataatcaaaaacaaatgcattatttttcgatggaatttttaatgggtcgtttattagttaataatatgatgaacctaggaatatatgatattgctaaagaaggattggctgaatttggtattaatattcatgatttagaggaattggaatctgatgctggtcttggaaatggtggattaggtagattagcagcatgttttatggattctttagcttcacttgcttatccagggcatggacatacaattcgttatgaatttggattgtttaaacaaaaaattgaaaatggttatcaaattgaattacctgatcaatggatgcaaactggttttaattgggaagtaagaaaaccaaaacatcgtgtaccagttaaattctttggaaaaattgtttacaatgatgcaactggaaaatatgaacatattgatacagaagaagtatatgcagtaccttatgatgtaccaattattggtaatgatacaactactactaatactttaagattatggggtgctgaagctagtgaaaatattcctgctaatcaagattttagacattatattcaaaatgttcgagatatttgccaaatgctttatccagatgattcaacaccagctggtaaaatgttacgtttaaaacaagaatatttctttacttgtgctggattaagttcaattgtcaaagcacatttaagaaattatccaaacttggataatttccatgaaaaaaatgttattcagttaaatgatactcatccggttcttgcaattcctgaattaatgagaattttaattgatgaaaaaggttatgaatgggatgatgcttgggatattactacacaaacttttgcgtatacaaatcatacaattttagctgaagcattagaaacatggccaatagatgtgatgcaaacgttattgccacgtatttatcaaattattgaagaaattcatcgtcgttttattggttatgtaaaaatggtaagtaaccgtgatgaagaattattgaatcgtgtaatgattttaagagatggtttggtatatatggcacgtttagctattgtaggaagttttagtgttaatggagtggctaaattacattctgatatattagttgaacgtgaattaagagattttgctattttgtatccaaataaatttaataataaaacaaatggggtaactcatcgtagatggcttgcatattgtaatccacaacttgcttctttaattactgaatatattggagatgagtggattaaacacccagaaaaattagaagatttaatgaattatgttgatgatgtaaatttacaagaacgtttcttggaagttaaaaaagaaagaaaacaagttttagctgattatattttaaaacataatggtataaaagttgatgttgatagtatttttgatattcaagttaaacgtctacatgcttataaacgtcagttattaaatattttacatgtaattgatttatattttagaatgaaagaaaatcctgattatcgtattgaaccaagaacatttatttttggagctaaggcagcaagtggatattattttgcaaaaaaagttattaaattaattaatagtgttggggatgttgtaaataatgatcctgaaacaaataaatatttaaaagttattttcttagaaaattatggagtaactttagctgaaaaaattatgccagctgctgatgtttctgaacagatttctactgcaggtaaagaagcaagtggaactggtaatatgaaatttatgatgaatggtgcaattactttaggtactttagatggagctaatgttgaaatttctcaacttgttggtgatgaaaattgtgttatttttgggctaaaagatcatgaagttaaagaactacaaattaatggtagttaccatgcttgggatgtttataataataatccacgtattagacgtgttattgatagtttgatggatggtacatttattgaaaatagggaagaatttagagttatttttgaagaattgatgaataaaaatgatgaatatttcttattagctgattatgattcttattgtcaagcacaaatgagagttagagatttatataaagatcgtcataattgggctaagatttgtttgattaatattgcaaaaagtggattcttctcatcagatcgaactattcaagaatatgttgatgatatttggcatttaaaaaaattaaaattttag

SEQ ID NO: 2472 - DNA, 2223 bp, Unknown
  Artificiall/Consensus sequence
atggcagagtataaaggtgctaatgatgttgtttcaattgatgatattttagatgtgtgtggtaagtatattactaataaagatagtctaactttaattaaacaagcatatgattttattatggataaacataaagatcaaaaaagaaaaagcggcgaaccgtatactaatcatttaatttgggtagcttatattttagcaacattacaaactggtccagcaacaattgcagccggattgcttcatgatgttatggaagattgtaatgttagtcatgacgaaatggttgagcgttttggtttagaaattacgacattagtagaaggggttactaaaattggtaaaatgccttttaaagatgaagctgatgtttatgcggaaaatcatcgtaagatctatatcgctatggctaaagatattcgtgttatcttgattaaatttgctgatcgtttgcataatatgcgaactttacaatacatgcctcctcataaacaaaaaaggatagcaagagaaacattagaagtttatacaccgattgctcatcgtttagggatcaatgatattaaaacagaacttgaggatttaagtttatattatttagatcctgtagcatttaaagaaatttcgaatcttttagcagttaagcaagaagaaagaaaagaatcagtagctaaaatgatggcaaaggtaaagaaaatgcttgatgaaaataattatgaatatcgaattttaggaagagcaaaatcaatttatagtatttataaaaagatgtttgttaaaaagaaaagattcgatgaattatatgatttatatgcattaagaatcattactaaagataagatggattgttatagtattttaggggtaattcatgatcattatcgaccaattccaggacgatttaaagattatattgcaatgcctaaaccaaatatgtatcaatcattgcatacttcagtaatcggtgaagatggtaatacttttgaaattcaaattagaactgaagaaatggatgaacttgctgaattaggggttgcggctcattggcgttataaagaaaataaaggctattcatctaaaaaagaacaacaagaaattggtgaaaaattacaatggttaagagaatttatttctttaagtgatgatattaaagatggcgatgccaaagaatattatgattcattaaaaagagatatttttgaagctaatgtatatgttttaaccccacaaggtaagatagtagaactacctaatggttcaacaccaattgattttgcttatcgaattcatactgaagttggacataaagctgttggagcaattgttaataatgttatggttccaatcgatactaaattaaagactggtgatgtagttgaaataaaaactaataaacaatcacaaggaccaagtgaagactggttaaaatttgttcgtacagctggggctcgtaataaaattagacaatttattgcgtcaaaagaagctgaaactaaaaaagacttaattgaagatggtcgtaaaattttaagagaagagcttagaaaacgtcaattggatgaaaagaaatatatggatcctgatacttataaaagttttttaggatcatttggagctcgtagttttgatgatattttgtattttattggtaaaaagagtttaccaatcatgactttgattgaccgtgttgttcctaaaaaaagaggtttctttgataatctttcaaagatgttacaaagaaataatcaaattaatgaaaaacaaagtagtagaggtaattctggtgttgttgtaaagggaattgatggcttgaaaatacaattatctaaatgttgtaatccgattcctggtgatgaaatattaggttttgtttctcaaggacaaggaatcaaagttcatcgtaaagattgtccaaatattaaagtaccggaaattcaagctcgcttaattgatgtgtattgggattttgcttcgatttcaacgatgaaatttcaagctgatttagagattactggtttggatcgaactaatttattgaatgatgtaattacggtattaggtcaattaaaaataaatatcttaaatattcgtgctgatgttgttgatatgaaagcaattattaaattaaagatatcagttgaagatgcttatcgtttgcaacaggcaatggataatgttgttaaaattcaaggaatttttgaagttaaaagagttattcattaa

SEQ ID NO: 2473 - DNA, 3711 bp, Unknown
  Artificiall/Consensus sequence
atgaaaatgccgattagtcctttaaatgatggtcaatatgaagccgttattacccgtaattgttcaattttagtttcagctccagctggttctggtaaaacaaaaatattagtaaatcgcattcttgccctaatcgaagaagaaaattataacgttgatgaattattagttttaacattcactaatgctgctgccttagaaatgaagcaaagacttcaagtagcattagatcaacgtcttcaagatgatataactaatgaattatctaatcacctattgaaacaaaaacaattacttcctaaagcctatatcacaaacttccatggcttttgtagtactttattaaaacaatatgggtatttaattgggataaatagtaaatttgatatttgtactgatccaactacaataaaacatcagattcttgatcagtgtattgaaaaatggatcaatgatgatgaatttatggaatttattaatttgtattttcctgaatattattttaaaagttttaaaaatgctattttgaaatttgaaaatctaagtaacacaatctataacttttatgactatattaatgaaatagaaaaaaatatttatgatcatattattaatggtaatgaagatgattataatagttggccaattaatgaaaaaatttttgaattattaactaaacaagcaaaaatgggattaaataaagtatatgaactagcaagctttgctaaaaataacaatttatcattttattatcaaaatccttttggtagtgataatccaaagaaagctgaccttcctagtccatttgattgtcatttaaaatactataacgatgttattaaagcaattgatagtaaagatattaataaaataataactgctagtaatgcttcattaattaaatcatatgatgctcgaggactttttaatgaagacaatgaaaatgctaaagctgaatataatcgtttaaaaaatggaatagtaaaattctacaaagatactttcaatgatttagtatatgataatttagatgaatttaaattgactctatcaacatcaaaaatcccattaaaaacactaatcaattatttaaaaaaatttaaaattgcttatcaagaatacaaaacccaaaataatttattagattttaatgatcttgaagcaaatgcccttgaacttcttgaaccaaaatacaaaattgctaatcttttgtataaccaattaaaagaaatcatgattgatgaatatcaagatacaaaccaaattcaagaaactttgatcaataaaatagctgacttaaaaaagcctgtaatcaatcgttttatggttggtgatatgaaacagtcaatttaccgttttagagaagcagatccaaaaatatttagtgataaatacaatacatttaatcgtctaccaaacacaaaaagaattgatttaaaatttaattatcgttcaaataaaatagttctagatagtgttaattatatatttaatcaaattatggacaacgatattggtggtcttgattattacttagatgaaagtgctaaattaaattacgattatttaagaaaagaaggtgcaaaagaactagaagatttagattcagttacacttaatgcctcaaaacgtcttgatcaagaaaatcgttttacaactgaggtattattatcatatcaaactaatataagttcaaaagatgctgaattagaagcaaaaatagttgcaaaaaagatccaagatatggttggtaagcttgaattagataattttaataaaacaaaaagattaactgaatataaagatattgtagtattaatgagaaatactcgtaattttattgcttttaaaaaaattttttctaaatacaacattccaagtcacattgttttatctcaaggatttttacaatcaaatgaaataattagtatctttaatgtacttagtgcttttgataatcatttaaatgatattgcctttactagtttactaaaaggtaattatgtaattagtaattttagcgaagatcttcttttaaaaattagatgtgatgatagtatttcaatgtatgataatgttttgaattatatcgaatctaaacaaaaatattatcaagaacttagtacatttattgattactatcatgaaatgcgtcagtattttaattatcacagtgttaaagagggtttaaataaattttatcaagatagtgaatatttgagttttttagcttcattagtaaatggtgctcaaagagttgcaaatatggaattattattacaaaaaatggatgaaatgaaaaatgaatcattacatagcattgtttgtaaatttgatgaaatgatgaaaaatggtgttaatatgtcgccagctatggtttcaagtaatgatgataatgttgtctctttcatgacaattcataaatcaaaaggattagaatttccaattgtatttgtatcaaaccttcaaaataaatttaatcaacaagatgctcgagaacgaataattagtgataaacaattaggaattgcaattaaaccgcgtttatcaaaacaactaggtaattatcaaaatgttttcattgaatatgaaaacaaatatcgtaaagttatagccaaatgtcaaacaaatgaatcaattgatgaagaaatgagaatattttatgttgctttaactagagcatcacaaaagctcattttaaccggtttaatcaaagaacctcaagatattattaaatggcaaaaatacattatcaataacaacgaagattcaattatcaatcctcgctgtaatgataaagtaattctttatctaaatgctagaaaacaaaactcatatttagactggttaggtatttctttaatgcgccatgatgatattatcaatcaaggaataaataaaaatttactagataaaaataattctgatgaattaattaatgaaatcaagcataatttccaaacaattatgattcataaaagtaaaaatctaattaaggaaaatactaaacacagtaaattttcaattaaattattttcacatgaagatattgaacaacaaattctaatcaacaatcaaatagaaactacactagatctagcaaattatcaaagaaataatgaatatgtatatcaatacccacttattgaaaacaaagctattgcagttaccaaaaaaattcaaaacatttatcctaatttcaatgacttaaatcatgataatactagtgattttggttttgaagcaacaacacgtggaaatattattcacagtgtattagagcatatggattttaatctagatttagatgataatttaaaaatattaaaagatattgaattgtataatcaagatgaatggaatatcattaataaatattattcacacttcaaagctttctttgaaagtgatgtctgcaaactaatgaatagtgctaaacaattatataaagaaaaaagtttttcaatgatggatgaaggacaaattatccatggtatctttgatgcaatttgtataaatgacaataatgttacaatcattgattacaaaacagatacactcaaaaaatcaacttcaaacgaaacattaattaatttacataaagctcaaatggattattataaaaaaattctagctcgcgttttcccacaagcaaatattcaagcaatcgtttattatttaaatattgataaatatattataataaaataa

SEQ ID NO: 2474 - DNA, 2412 bp, Unknown
  Artificiall/Consensus sequence
atgaataatcaagagcattttggaacattgacaccaagaatgaatgaatttagagaaaagcttttggataaaaagccatatatttgcgctcaaagagcattgcttgcaacagaagcttataaagaaaatcaaaatcaaccagtagttatgaaacgagctttgatgttaaaaaatattttagaaaaaatgtctatttatattgaagatgaaacgttgattgttggaaatcaggcatcttctaatcgtgacgccccaatttttcctgaatatactttagaatttgttcttaatgaattagatttatttgaaaaacgtgatggtgatgttttttatattactgaagaaactaaagaagcgattcgatcaattgcgcctttttgggaaaataataatttaagaagtaaaggtggagcattgcttcctgaagaagtaagtgtatttatggaaacaggtttttttggaatggaaggtaaattaaactctggtgatgctcatttagcagttgattatcaagaagttttaaaaaagggattaatcggttatgaaaaacgagttttggaattaaaggataatttggatttatgtattagtgaaaatattgataaatatcaattttataaagctgtattagttgtaattgatgctgttaaaacttatgcaaatcgtttttctgcattagctaaagagttagctaataaacatactggtaaacgaaaagaagagttattaaaaataagtcaaatttgtcaaaaagtaccatattatcctgccgaaacttttcaagaagctcttcaatctacatggtttattcaattgatcttacaaattgaatcaaatggacattctttatcatatggtcgttttgatcaatatatttatccatattatcaacatgatattgataatggtttaattactgaggatgaagctgtagaattacttacaaacttatggatcaaaacaatgacaattaataaagtacgtagtcaagctcatacatttagtagtgcaggaagcccaatgtatcaaaatgttacaattggcggacaaacgcctgataaaaaagatgcaacaaataaattatcatatttagttttaaaatcagttgcccaaacaagattaccacaaccaaatctaactgttagatatcatcgtaacatgccaaaagaattcttagatgaagcaattgaagtaatgaaactaggaacaggtatgccagcatttaattcagatgaagttattattccttcatttattgaaaaaggtgttaaagaagaagatgcttataattattctgcaattggttgtgttgaaactgctgttcctggtaaatggggatatcgttgtacaggaatgagttatatgaatttcccaagaattttattaattgcaatgaatgatggaattgaccctacttctaataaacgctttgttgaaggatgcggtcattttagagatatgaaatcatttgatgaattaatgaatgcaattaatgttacaattagaaaattaacaagaatgagtgtaattgtagaaaatgctattgatttagcattagaaagagatgtaccagatattttatgttcagctcttgttcaagattgtattggtagaggtaaaacaattaaagaaggtggcgcaatttacgactttatttctggtttacaagtaggaatcgcaaatatggctgatagtttagcagcaattaaaaaattagtatttgaagaaaagaaaattacacctgaacaattatgtaatgcactagaagatgattttactagtgaagaaaatcaaaaaattcaacagatgttaattaatgatgcaccaaaatatggtaatgatgatgattatgtcgataatttagttgttgaagtatataacgtttacattgatgaaatgaaaaaatatccaaatacacgttataatagaggaccaattggaggaattcgttatgctggtacatcaagtatttcagcaaacgtaggacaagggttttcaacaatggcaacacctgatggtcgtaaggctcatagccctcttgctgaaggatgttcacctgctcattcaatggataaaaatggaccaactgcggtgtttaagtctgtttctaaattgccaactcatgaaattactggtggggtgttattgaatcaaaaagttacgccacaattacttgcaagtgatgaaaataaggaaaaattagaaatgttaattaaaacatttttcaatcgtcttgatggctatcatgttcaatataatgtagtatcaagagaaacactaattgatgcgcaaaagcatcctgaaaaacataaagatttaattgtaagggtggcaggatattcagcattctttaatgttctatctaaagctactcaagatgatattatcgaaagaacagaacaaacattataa

SEQ ID NO: 2475 - DNA, 3981 bp, Unknown
  Artificiall/Consensus sequence
atgaaaaagattttaaaaattgtgcttgctttagcacttgcttttagtggaatagtggttggacaagtaaacaatgtttatgcatctaatgaaaatattagtgcatatccacatgttcaatcatatcaaacaactaccggaacgttttttcttgctagagaaagtcgtatctttattgttgaaaatgaaaaaacaattgataaccaagcgttattagatgatgttgaattattaagttcgcaactaggaacacttttagataaatctccaaatattgttattggtgataaagccaatgtattagaaaatgatattgtaattcaattagaagaacttgaagaattagctagtcacaatcaaagttatagaattgatattgatgatcatattacaataactgcaaaagataatattggtatattttatggtgtacaaactttaattcaattattaaaaattaatgattatacattattgcaaggaacaatcttagattggccggatactaatgaacgttctatgcatcttgatttagctcgtaaatattttagtattgattggatcaaagatttaattgaagaaatgagctatttaaaaatgaattctttacaaattcatttttcggaacatgaaggatatcgtttagaaagtgatgtattaaataatgttgaaggatttaattatccgtctcaatactatacaaaagaacaaatggctgaaattgttcaatatgcaaacaaacatcatattgatgtaattccatcattagattcacctggtcatatgcgttatgtcttaaattatttaccaaatgaatatagattaagtagcgtttctaatttagctagcgatggagctgctaatggaacatttaatatttttaatgaagaagctaaagattttttaaagagtttatttactgaatatgctgagtttttctcagaacttggttgtacaaaaatgaatattggtggcgatgagttcttaaataatttttcattacttactgaacaacaatattcaggtgttatgaattattttaatgaaataactgcaattttaaaagaatatggaatgacaccaagagcatggaatgatggtttaatgtttacagtatatgataaggattcttatcatttagatccatcaattgaaatttgttattggtcaggtggcgataactgtgcaacaattgctgactttgttgaaaatggtaataaagttttaaactttgctgatgtgtacatgtattatgtccttgctcaatggtgggatcaatatgcaaatgctagtgcagaaaaaatatataacgaatggtcaactggacgctgtggagatgcacgtaaagatggtgaaattatcccacaaagatacgaagaaccatatcctgattttttaattggtagttcatttgcactctggtgcgatcaggcaaactataaaacagaagatgaagtaagagagcaaattaaagatcgtatgcgtgctatggctcttaaagcttggaatacaactgaacaaatgagcgaatatagtgaagttaaagaagcatttgataaagccggtagagcaccagcatatgatgataatttacctgaacctgggcaagttattaatgatgaacaatctagtgcaatagtaattaaatattgtgacagtgatggaaatagtattgctaaaaatgatgtgttatatggtttaactggtaaaacatatacaattacaccacaacctttatatggttatagttatgttgaagctagcgatgaattaactggaacatttgatggacaaaaagaaattgttttaatatatctattaagtagtgataaaactagtctagaagaaagtataaaaaataaagctaatcaaaatgattatgttttacaaacatatcaagtatataatcaagcatatgaaaatgcagtaaaagtatatactaatgaaaaagcaactcaagtagaagtagatgaagcttatcaaacattattagatggttataatcaattagtaccagtaacaaaacaagaattatataatctagttaattgtgctattcaagaacaaggaaactattcaccaaattcatttactagatatcaaaatgctatagctactggaagtgcactattaacaactgatacaacagatgatgtaattcaaactgcaattcaaaatattcatgaagctagaaatcaattagcacttagtgcatttattgtagcttctactgacgtaccgacttatcaaaattatggtatttcaaatactattgatggaaatcgtggtacaaaattctggggacaatcaacacaaaatcctggtcaatatttcctatatacatttagagaatcaattgcattaaatcaaattgttatagcaacaggttatgatagtaatggtgtaaatgaaaatgctgactatattagaggtgctgatgttttagtaagcaatgatggagcaagttggcaaaatgttggaaaattgagcggtgaacatgaattagttattgatgtaaataatgttgaagcaaaatatgtaaaaattgaaattactgaatcaagtgcaaactggccacaattaaatgaagtatcatttacgtatgatataattggtcgtgatcttcaagaaattattgatgaagctaaaaaaatcgatagttcattatatacaagtgaaagttatgcatatttaaatacagcaatttcaaatgcagaaaacttaggtgtagatgcttcatatgatcaaaaagctttagcaatttataacatcgatcaagcaattaaatatctacaaacacttcctgagggaagtaatgattcagttgtatcttttgaaatagaacatccatggattgttcaaaccggaacagttgaaatggttgaaaatacagaagcaacaaatggtaatcaatatgctcttacaagcaagagtgctacattcaaccttgagatgatgggagatatgatttctatttatggtcaaaaaggaccagaaaacggaatgatgaaagttactatttatcaaggcgataatgtaattagtagtgaagaagtaagtactgcaagtgaaactgctacacaggcaatgttatatcaaaaagcacttgatgcaggtgaatatagaattgttattagtaataattcatcaaataatgttgtagttgattatgttgaaattgaaaacggaacaatctttaaacatgatccaattagtattgatacaaataaagataaattacaaatagctgttgatctagctagtcaagtaactcaagaacatcttgataaacttgtgccaattgttgttgaggagtttaaaaatgcattaactgaagctaaagaaattttagctagttcaactgtaactcaagaacaagtagatgcatcatttgatcgtttatcaagtatcatgcaacgattagaattctataaaggtgataaaacacggttacaagaattcatcgataaatatacaactaatttagatgaaactaaatatacacctgaaacttgggcaatatttatagctgaattaaatgaagctaatgttgtattagatgatgtaaatgcattacaatatgaagtagatcaagcatatgatgaattagtacgtgcttatgtaaacttaagattaatacctgataaaagcttattagaagaattaattaatcaagctaaaaaactaaatggatctaattatactgaagaaacatggaatgcattattaacagcattaaataatggaattacaacatatgataatgttggggctactcaagtagaaatagataatgctgctaatgcattagctaaagcacttgctgctttacaacctaaagttagcattagtacaccagtaaataacagtgatagtactacaagtgtaaaaacagaagataatagcttaactggaatgtttgcaacaatggcattattaagtttagcgggttatagtcttttaagaaaaaaagaaagttaa

SEQ ID NO: 2476 - DNA, 2565 bp, Unknown
  Artificiall/Consensus sequence
atgaacattgaaaagtggacaactaagatgcaagaggcgattcaaaaagctattaaaatggctagtgaaatgaatcatcaagtagtagatgtagaacattttttattagcattattagaagataatgcaggtattatgtatcgtgtgttagtaaaatgtaatgttgatattgctagattacaaaatagcttaactgcaagattgcaaaataagccgattgtaaataatgtggatataaatagcatacgtctttcttatgatttgaatcagttatttggtttagctgataagcaaatgtctaagttcaaagacgagtatttaagtgtagaacatttgatcatggctttatttgatttgaatagttcatgggtcaaagatttattaaatgaatttcatttaaatcgaaaagatgtaaagaaagttattgatgaaatgcggggtggaaatatggtaaataatcaaaatcctgaaaatcaatatgaagtattagaaaaatatggacgtgatttaactaaagatgtagctgatggtaaacttgatccagtcattgggcgtgatgaagaaattcgtcgtgtgattcagattttatcacgtaaaactaagaataatccaattttaattggagaaccaggtgttggtaaaactgcgattgtagaaggattagcatggcgtatttttaaaaatgatgtaccagtttctttgcaaaataaaactttatatgaattggatttaggtgcattagttgcaggggctaaatatcgtggagaatttgaagaacgtctaaaagctgttttaaatgaaataaaaaaagcagaaggaaatattatcttatttatcgatgaaattcatcagttagttggtgctggtaaaactgatggggcaatggatgctgcaaacttattgaaaccgatgttagcacgtggtgaacttcactgtattggtgcaacaactttagatgaatatcgtatgtatattgaaaaagatgtagcgttagaaagaagatttcaaaaggttcaagttgatgaacctgatcaagatgatacaattgcaatcttacgtggtttaaaagattcatttgaatcacatcacggggttcaaataactgatagtgcaattattggtgctgtaaatatgtcacaaagatatattactgatcgttttttaccagataaagcaattgatttaattgatgaagcatgtgcttcaatccgtatggaaattgattctttgccagaggaacttgatacgattactcgtgagaaaaatcgtttggaaatggaacgtatttcaattgaaaaagaagataaaagtgaagataatgaaaaacgtttaaacgaaataaaaagtcgtattgcttcattagatgaacaagtaaaaggattaagtgacaaatggcaagaagaaaagaaatctttggatcatatcaaagaattaaaagatcaaaaagttcgtttagaagcattaaaagaaaaatatcaaacagaaggtaatttagaagaagcatctaagatcaaatatcaaacattacctcaaattgaaaaagaaataagtcaatttgaagcatctaaaaaagaagatgatttattacaggaaaaagtaactgtagaaacagttagcgaagtaattgctcgttggactggtatacctgtaaataaacttatggaatctgaacgtgaaaaattattacacctagatgaagctttgaaagttagagttattggacaagatgatgcaattgaaaaagttactgatgcaattttaagatcacgtgcaggtattaatgatgaaaaccgcccaattggaagtttcttattcttaggacctacaggagtaggtaaaacagaagtagcaaaatcacttgctgaacaattgtttgatactgaaaaaaatattgttcgaattgatatgtcagaatatatggaaaaatttagtgtgtctcgtttagtaggagctccaccaggatatgtaggctacgaagaaggtgggcaattgactgaagcggtacgtcgtcatccatatagtattgttttattagatgaaattgaaaaagcacatccagaagtgtttaatatcttattacaagttttagatgatggacgtattactgattctaaaggtaatttggtaagttttaaaaatactatcattattatgacatcaaatattggttccaactatttattagaaggaaataatgaagaaactagagcagcaatcgataatgaattaaaaaatcattttaaaccagaatttttaaatcgtattgatgaaattgtttacttcaattctcttgatcaaagtgttgttaacaaaatcattaataaattcattaatcaattatcacatcgtttagaggataaaaagataactattaatgtaactgatcgtgctaaggcaattattagtgaatatggttatgatgtgacatttggagctcgtccattaaagagatttattcaatctaatattgaaactttaattgctcgtgaaatgattaaaggaacaataaaaaatggaagtaccgtaactgttgattatgatgatggatttaaattgattagttaa

SEQ ID NO: 2477 - DNA, 1422 bp, Unknown
  Artificiall/Consensus sequence
atggcaacctacaatccagtcacccctgaaatcatcgaagagctgaagaagatctccggcgaccgcgtcgtcgtgggcgcggacgtcaaccccgactactcccgcgacgagatgcccatctacggcaccaagatgcccgacgtctccattgatgtgctgagcaccgaagaggtctccgccatcatgaaggtctgctatgacaacaacatccccgtgacctgccgcggcgccggcaccggcctggtgggcgcctgcacccccatcgccggcggtgtggtgctgtgcaccatgcgcatgaagcagatcctggaatatgataccgacaactttgtcgtccgggtccagcccggcgtgctgctcaacgacctggctgaggacgccctgaagcagggcctgctgtatccccccgatcccggtgagaagtttgccacgctgggcggcaacgtctccaccaacgccggcggcatgcgggccgtcaagtatggcgccacccgcgactatgtccgggccatgaccgtggtcctgcccaccggcgagatcgtcaagatgggcgccaccgtctccaagacctcctccggctactccctgctcaacctcatcatcggctccgagggcaccctcggcatcatcaccgagctgaccctcaagctcatccccgcccccaagcagaccgtcagcctcatctgccccttcgaggacctggccacctgcatctccaccgtgcccctgttcaagaaggcccacatggacccccaggctctggagttctttgagcgagagatcctcatctcctccgaggagtatctgggcaaggccgtgttcccccgcaacatcggcgggcaggacgtgggcgcctatctgctggtgaccttcgacgccaacacccaggacgccatcgacgccctggtggagcaggccgccgagctggtggtcgaggccggcgccatggacgtcctggtggccgacacccccgccaagatgaaggacgcctgggccgcccgctcctccttcctggagggcatcgaggagcagaccaagctgctggacgagtgcgacgtggtcgtccccgtctccaagatcgccgacttcgtgctctacatcaaggagatcgacaaggagttcgactttgaggtcaagatgttcggccacgccggcgacggcaacctgcacgtttacacctgctccgtggacatggagatggacgccttcgtcaagcaggtggaccagttcatgcgcaagctctacgccaagaccaccgagctgggcggccagatctccggcgagcacggcatcggcatgggcaaggtggagtacctggccgagtctgtcgggcccgtcaatatgcgcctcatggaggagatcaagaaggtcttcgatcccaagatgatcctcaaccccggaaaggtctgctacaccctctga

SEQ ID NO: 2478 - DNA, 1506 bp, Unknown
  Artificiall/Consensus sequence
accatgccagagtatgcaaagaaagatttggaagaactcatcatcggcaagctgcgccggaacttcggccgtgacgtggacgaggccaccgccattcatatgttcaaggcctgcgccatggtgctgcgggacatcatgtcagcccggcagctcaagaccgaggacaaggtgcagcgcacccacgcccgccagatccactacctgtccctggagtttctgatgggccgctctctgatgaaaaacgcctacaacctgggcattctggaggagctgaagggggccatcgaggatttgggcttctccgcccccgacctctttgaaatcgagcccgacgctgggctgggcaacgggggcctgggccgcctggccgcctgctatctggactctatgaccaccctggagatcccagccaccggctataccatctgctatgagctgggcatctttaagcagaagatcatcgacggccagcaggtggagctggccgacaactggctgcctgtgggcgacgcctggctcatccccaaggtggatgagacggaaaaggtccactttggcggccgggtcaaggacgtctgggacgagaacggaggccaccgggtggcgtacgagggcggcaccgacgtattggccatcccccgggacatggagatcgccggttacggcaccgagcacaccaacgtcctgcggctgtgggacgccaagagccccgacccggtggatatgaagctcttctccaccggccagtatctgaaggcggtggagcagcaggccatggccgaggtcatcgccaaggtgctctaccccgaggacaaccactacgagggcaagtccctgcggctcaagcagcagtatttcttcgtctccgccaccgtccagtccatctgccgcaagcacaaggcggagtacggcaccctgcgcaatttccatgaaaagcacgtcattcagatcaacgacacccaccccaccctggtcatccctgagctcatgcgcatcctgctggaccaggagggctacggctgggacgaggcgtggcacatcgtcacccacaccgtggcctacaccaaccacaccattctctccgaggccctggagcgctggccccagcagctcatcgagaccctgctgccccgcatctggcagcttctgatcgagatcagcaatcgctatcaggcccagctcaacgaggcgtttcacggcgaccaggccaaggtgcgggacatggcggtgatctggggcggcgaggtccgtatggccaacctgtgtatctgcgcctgtttcgccgtcaatggggtgtccgcgcttcactcggagatcctgaaaaaggacgtcttccacgacgcctatacccagaacccaggcaagttcaagaacgttaccaacggcatcgaccaccggcgctggctgtccgagatcaaccccgcgctggacgcgctgatccgggaatgctgcggcggggacgactacctgctccgccccgacgccgttcagaagctggagaaatac

SEQ ID NO: 2479 - DNA, 1044 bp, Unknown
  Artificiall/Consensus sequence
caggaggagcgcattcccaaggagatcatcgagaagatggccgagattggcttcaccgccctgaacgtccccgaggagtacggcgggcccggtctggacaccgtgtgcaaggtgctggtggtctccgagctggcccggcagtgcgccagcaccgcggaggtcatcgccgtgcataccctggtcaacgacatcttcctcaagcacggcaccgaggtgcagaagcagaagtacctcaccgccgccgtggagggtaagatcggcgccttcgccctcaccgaggcgggcgctggctccgacgccgccgcagccaagaccaaggccgtggtggacggggacgactacgtcatcaacggcagcaagtgcttcatctccaacatgggccccaccgagggcgactatgtggtggtcatcgccctcaccgagccggagaagggcgtcaagggcatgtccgccatcgtggtggaccggggcacccccggctttaccgtgggcaagcgggaggagaagatgggcatccggggcgcggatatctccgagctgatctttgaggactgccgggtcccccgcagcaacctggtgggcaaggagggcgaaggcttcaagatcgccatgatggcgctggacggcggccggatcggcatggccgcccaggcgctgggcatctgcgaggccgctatcgccgcctccgtcaagtacatgggcgagcgggtccagttcggcaagcccatcggaaagaaccagggcctgcagtggtatctggccgacatggccacccgcaccgaggccgccaaggccctcatcctggaggccgccgtcgccgccgacaacggccagccgctgtccaagctggccgccatgtgcaaatactacgcctctgagaacgccgtctgggtcaccaacaaggcccttcagatccacggcggctacggctacatgcgggactatcccatcgagcgcatgtaccgcgacgcacgcatcgtccccatctacgagggcacctccgaggtccagaagatggtcatcgcacgcgaggtcatgaagtaa

SEQ ID NO: 2480 - DNA, 1719 bp, Unknown
  Artificiall/Consensus sequence
atgaagcagaagaaggtgctgtcgctgctgctggctgtggccatggcgttcagcctgaccgtaccggccgtggcggcagagggcgacgccgcaggcacggagagcggcaagatcgtgatcctgcacaccaacgacgtacactgcggcattgatcaggccaagaacgacgcaggggaggtgaccaacatcggctatgcgggcgtggccgcgtacaagaccgccatggaggcggcctacggcgcggagaacgtgacgctggtggatgccggcgacgccatccagggcggccccatcgggacgctgtccaagggcgcgtacatcgtggagattatgaaccaggtgggctacgatttggccattccgggcaaccacgagtttgactacggcatggacaacttcctgaccttggcgcgggagaaggcggagtatgcctatctgtgcgccaacttcaccgacctggaggggaaggcggtgctggacggctatcaggtgctgacctacggcgacgtgaaggtcggctacgtgggcatcgatacgccggagtccttcaccaagtccaccccgacctatttccaggacgccgcggggaactatatctacagcttcagccagggcaacgagggcagggacctgtatgacgtggtgcagaaggcggtagacgcggccaaggcagagggcgccgactacgtggtggcgctggggcacctgggcgtggacgagcagagctccccctggacctccaccgaggtgattgccaacaccaccggcatcgacgtgctgatcgacgggcactcccacagcacctttgccaagaccgagaagaaccaggccggggaggacgtgctggtggcccagacgggcaccaagctggccaacctgggcaaggtggtcatcgacaccaagacgggcgagatcaccagcgagctggtggcggccaaggactgcgccgctgaggacgaggccactggggccttcgtgaagggcatcaacgacgagtttgccggggtgctgaagaaggtcgtggccaagaccgacgtggacctgaccaccaaggacccggccaccgggaagcgcgcggtacgcagcgccgagaccaatctgggcgacctgtgcgcggacgcctaccgggtgatgctggacgccgacgtggcctttgtcaacggcgggggcgtgcgcgccgacatccccgcgggggagatcacctatgagcagatcatcaacgtgcatcccttcggcaacgaggcctgcgtggtggagaccacgggccaggacattctggacgcgctggagatgggcgcgcgtgtgacaccggaggagaacggcgggtccctgcaggtctccggcctgacctataccatcgacacctcgattccctcctcggtggtgctcaacgacgagaaggagttcgtgaaggtggacggcgagcgccgggtaaaggacgtgaaggtgaacggcgaggccattgaccccgccaagacctacacgctggcctcccacaactatatgctgaagtccggcggcgacggcttcgttatgttcaaggacgatgccctgctgaaggactgcgtgatgatcgacaaccaggtgctgatcaactacattgtggacgagctgggcggcgtggtgagcgccgactactccgatcccaagggccagggccgcatcacggtggtgggcgccccggctgaggagcccgaggctcccgccgactgggcggat

SEQ ID NO: 2481 - DNA, 1872 bp, Unknown
  Artificiall/Consensus sequence
gccggctgggaggtgacgcggccgatgttctttaagctggcgcggagaaacgtcacccgcagtctcaaggactactcggtgtactttctcaccctcaccctgggggtgagcctcttctatgtgttcaattccctggagggacagtgggcgatgcagatgctggccaaaagcgcccactatatggtggaatccatcctcatcttcatgaacatcttttccgccttcgtctcggtggtgctggcctgcctggtgctttacgccaacacctttttgatgaagcgccgcaagcgggagctgggcacctacttcttgctgggtctgcccgcaggcagggtctccctgctgctggtgctggagaccctgctcatcggtctgatggccctggccaccggactggtgctgggggtcctgctggcccagggcctggggctgctcaccatcgccatgttctccgcctaccctgccggggagcagttcgctctggtcctctccgtcaaggccatcggcaagacggtgctctacttcggcgtcatcttcctggtggtcatgattctgaccggggtgtcggtctcccgggccaagctcatcgacctgatgcagggagcccggaaaaacgaggagatgaaggagcggcccctgtggaccagcgtcctcaccttcctggccggggtggctctgctggtcgtcgcctacgccatgctcctcatccggggcatgctgtatatcgacccgctgttcttcctcatgctggccctgggtactctggggaccctgctgtttttccggtccctgtccggcttcctgctgcgggtggtgaaggggcacaagaagctttattacaggggcctcaacatgtttgtgctgcggcaattcaactcccgcatccacaccacctacctgtccatgacggtgatctgcctgctcctgctgctggccatcggcgtcaccgcctgctgtgtgggcctcaacgacaccatcgagcagaatacctcctccgccgccccctacgacgtcaccatccagaattacagtggggacaccaccgtggcggacctccccgcccggttggcagagtccggctttgaccccgctctgctgggggagcagcacgactttctcttctactacaacgaccccgccgtcaccggcatccccgcggacgacgcctatgccgtggtgctgctctccgactacaacgcgctgatggccctccagggcgggcaggccctgaccggggacggtctgccccttgtgaccgatcaggccatcgtgaccggctacagcggtatgaaccgctatcttgtggcccccgacagttgggcggaggcgctccaggtccggcggcaggtcttctgcgccaactaccggggcgacaagcagaccgccgaggacgcccttgccgccgcctgcagctcccccgccttttccgacgggctcacgctgtctctggacactcgcatcggaatctacacggagaatatgggcagcaagatcctggtgctgttcatgggactctatctgggcatggtctttctcctcaccgccgcggcggtgctggccctccagcagctcagccaggcggcggacaacgtgcctcgctatcagattctctcccgcctgggcgtcccggagcggatgcgggaccgctcggtactcacccaggtagccctgtccttcttcctcccgctggccctggcggtggtccactccatcgtgggcatgacggcggccaacgccgtgatctccgccgtggggcgggtggattcggtgcgcagcagcctggtcaccgccggcttcttggtgctcatctacggggcctacttcctggccacctgcttcggcgcccgccgcatcgtcaaaggaaacgggtag

SEQ ID NO: 2482 - DNA, 1371 bp, Unknown
  Artificiall/Consensus sequence
atgttcaaaaaatttaccaatggctgcgtgcgcgtagtcaaccggtggctgccggacccgttcctgttcgccatcatcctgagcatcgttgtgtatgtcgccgcaatgctcggtacacagcagggccctgtcgccatgatcaaggcgtggggcaacaccagcggtttctggaatctgctggccttctcgatgcagatggccttggttctggtgctgggctccgccatggcctccgcgaaggtctttaagcggttcttgggcgctatcgcctctaccgccaagaacaagaagagcgccattctcatcaccacctttgtgtccgtcatctgctgctggctgaactggggcttcggcctcatcgccggcgccctgctggccaaggaagtggcccgccgtgtccgcgatgtggactaccgtctgctcatcgcctcggcctattccggctttgtcatctggcacgccggtctgtcgggctctatcccgctgaccatctcgggtggctacaccatcggcgaggccacctaccaggccggcaccaatctgaccatcttccatcccatgaacctgctcatgtgcgcggttatcctgattgtgatgcccttcgtcaactacgctatgcatcccgatacggagcacaccattactgtggaccccgctctgctggtggacgaggctgagaaggagtattccgtcagcaccccggctgaaaagatggagcacagcaaaattctgtggatcatcaccattgtggccggctttgcttacatcgtcttctatttcatcgacgtggtccagaagagcggccctgccgggattcccaacagcctgaacctgaacatcgtcaactttatcttcctgtttgtgggcgtgctgctccacggcgatctgcgcaagtacgtggacgccatcggtgaggctgcctccggcgcggccggcatccttctccagttccccttctatgccggcatcatgggcatgatggtcgccgccaacgccaacggcgtatccctggcctccatcatttccgacttcttcgtcagcatctccaacaacgtcaccttccccctgttcaccttcctgtccgccggcatcgtgaacttctttgtcccctccggcggcggtcagtgggccgtgcagggccccatcgtgatgcctgctgctagtaagatgggcatcgaggctggccgtgcctgcatggccatcgcctggggcgatcagtggaccaatatgattcagcctttctgggccctgcccgctctgggcgtagccggtctgtccgccaaggacatcatgggctatctggtcatcgtgctgatctttaccggcctggtggcctgcggcggcttcctcctgtgggccgcgctgttctaa

SEQ ID NO: 2483 - DNA, 1536 bp, Unknown
  Artificiall/Consensus sequence
atgaacgaggaggcattggatcttaccgtaggtgttgacgggatcaaagatggctaccgggcaattcttgacaccattttttgcagcattcttgtgtttgacggtaatggacaactgatccactgcaactgcgccgcccggaattttttccatggactgggcattgatccggagcgcgcgtattttacccgttttgaggccttttccgagccgatggcagagcgggtggacctcatcagcgggaagggccgctacatcatcgagctggaggggaggcaggtggtctgcaacgtccacccgtgggtgatcgacggggtccggcggggcaccatttttatcctgcacgaatccatgcactccaactgcatcatgcaggagctggacgtgaccaacagcctgcttcaggagatcaacatcttcgtagagtcctctcacgacggcattttggtcaccgacagccaaggcgtcgttatccgggtcaacgccgcttttgagcgggctttttcggtcctccggcgggaggtcattggccggaacgtcacggagctcatcgccgagggcctgtacctggattcggcggccctcaaggtcctggagaccagggagaccgccaccgtggtcctggagcagaaggggaaacggctcattgccaccggtacccccgccttcgacatctgcggcagcttcacctccgtggtggtaaacattcgggacatcaccgagctaaacgacctgcaaagccgtctggagcaccagcgcatggtggcggagggctacatacgggagctgaccttcatccagagccagaatgcccccggtgcggatttcgtggtccacagcaaggaaatgcagcatatcatggacaccatcaagaccatctcccaggtagattccacgctgctcatcaccggagagtcgggcaccggcaaggaagtcattgtcaaccaggtccaccgctccagcaaccgccgggacaagcccatcatcaagatcaactgcggggccatccccgcgtccctgtttgaatcagagctgttcgggtatgaggacggggcctttaccggcgcccgccgccgggggaaggccggcttttttgagctggccaacgagggcaccctgttcctggacgagatcggagagctggatctggacctgcaggtcaagctgctgcgggtcatccaggagggagaggtcacccggatcggcggcaccaagacgcttcatgtggacgtgcgcatcattgcagccaccaaccgggacctctggcagcaggtccaggagggcaaattccggcaggacctctattaccggctcaacgtgatcaacatcgaggtgccgcccctgcgggagcggcgggacgatgtcatcccactggccgtccactttatcgagaagtacaaccaaaagtacagcaagcacaaggagctgtccatggaactgggcaagatcctgcgctccctggactggctgggcaatatccgcgagctggaaaacctgatcgaaaacatggtggtgctggtccagcgggacgtgctc

SEQ ID NO: 2484 - DNA, 1326 bp, Unknown
  Artificiall/Consensus sequence
ggcgcgctggagctgggtatcctgttctctgattttgacgccgcctacgccaccgccaagaaggacggctcctacaccctgacgttcgactggcgcgagcccctgcccgtgggcgtccgctggtttgaggacgtgaagaacaccgacgtacggaaggaaatcgccaagatccaggcccccgtgctggccatcaacggcgatcaggataccacggtcacccctgacaacgccgtggccatcgctcaggccgcccagaacggccggagctggctggtagacggcgccgacctcacctataatatcttcaccggcgactttaccgccatcacccagaccatcaacgtgggcatcggcttcctggaggagaccttcaacggcgcgctggagcccgcctatgccgcctccgtcagcaagtacggcaacgtcaccaccaccctgcccgtagatctctttgacggggccgggtacgccgtgggcgacattctgaagatcaccgtgggcgatcagaccatcgaggccccctacggcaccgcctatgccaacgtggacaacggcagcgtcatcgtcctgcccgacgcctccaccggcaccgtggccatcgccatcaacatgggcaacttcgcctccacatacaacgtcaccgccgacacccccatcgtcttcgccatgggggagaaggagggctatctggaggagtacgagatccgcaacatcgactctctgcgcaccaatgaccgggccgactacgcctccgacgaggtgttcgccaacttccgccccgtggtcatgggcgacatcgccgagggcgtgctgttccgctcctccagccccgtgaaccccgagctgggccgcaatactcacgccgacgccctggtggagaaggcgggcgtcaagaccgccatcaacctggccgacagccaggaggaactggcggcctatgagggctatgccgactcctactacgccacgctgaacgtggtggcgctggacatgggcgtggacttcgccgccgaggacttcaacgccaagctgaagaccggcctggagttcctcatcgccaacgagggcccctatgtcatccactgcaacgagggcaaggaccgcgccggcttcaccgccgcgctgctggaggccgtgtgcggcgccagcgtgggcgagatcgtggaggactacatgcgctcctacgagaactactaccacgtggagtaccactctgaccgctggttcagcattgccaacagcaatattatcaagaccctgtgcaccatcaccggcaccgagacccaggccgacctggagaaggccgacctgaaggccgccgctgag

SEQ ID NO: 2485 - DNA, 1359 bp, Unknown
  Artificiall/Consensus sequence
atggcattcgaaggtttgaccgaaaagctctcctccgcctttaagaagctgcgcggcaagggccgcctgtccgagtccgacgtcaaggaggccatgcgtgagatccgtctggccctgctggaagccgacgtcagctacaaggtggtcaaggagttcatcaaaaaagtcacggagcgggccgtaggcgccgacgtgctggagagcctcacccccgctcagatgatcgtcaagatcgtcaacgaagagctcaccgccctgatgggcggccagagcaccaagctgaacctatcccccaagccgcccaccgtagtcatgctggtgggtctcaacggcgcgggcaaaaccaccaacggagccaaactggcggggtatatgaagaggcagaacggcaagcgccctctgctggccgcctgcgataccttccgccccgctgccatccaccagttggaggtcgtgggcgggcagttggacattcccgtgtttcagatggggcagatcgacccggtggatattgccaaggccgccattgagcatgcaaagaagcacggcaacgacattgtgttcgtggataccgccggccggctccatgtggacgaggagctgatggaacagctcaaggtgatgaaggccgccattgaccccgacgagatcctgctcatcgtggacgccatgatcggtcaggacgccgtcaacgccgcccaggcctttgacgaagccctggacatcaccggcgtcatgctcaccaagctggacggcgacgcccggggcggcgcggccctctccatcaaggccgtcaccggcaagcccatcaaattcgtgggcgtgggtgaaaagctggaccaaatcgaggtcttccacccggaccgtatggcctcccgcatcctgggtatgggcgacgtgctctccctcatcgaaaaggcggagcagaacttcgacgcgaagaaggctgccgagctccaggagaagatgaagaaaaaccgtctcaccctgacggattactacgaacagcttatccagctcaaaagcatgggctcgctgtccgatatcgccgggatgctccctggcgtcaacgccaaggcgctggagggcgccaccgtggatgagcgtctgctgtcccagactgaggccatcatcctctccatgacccccgcagagcgggagaacccctccctgctcaactccagccgcaaaaagcgcatcgccgccggcagcggcacccaggttgtggacgtcaaccgactgctcaagcaatttgagatgatgcagcagatgacccgccagatggcaggcggcaagctggccaaaaagatgggccgcttcggcggcatgggtaaaaggaagggctttcccttcggatga

SEQ ID NO: 2486 - DNA, 1758 bp, Unknown
  Artificiall/Consensus sequence
tataccgcctccatgtacgccatcgccgaggagtcccgctggtacgacgtggccgaggagaacggctttatcgtggtctttgcccagggcctggtccgaccggctgatatgatgggcaacatccccaccgccatgtggcttgcgggtcccttttccgctctggccggcgcgggtgtggacaaagatacggatctgaagttccttgacaccctgctggataagctggaggaggaatacagcattgacaccagccgcgtctacgccaccggccattccaacggcagcctgatgacctgggccatgggctccaagtttgccgaccgttttgccgccatcgcccccgtgggctatatgtcggcgccgatggacgggattgcgtccggtaccatgctgcccacctggtccttcctgggcgagtacgactccgccggggatcccaccctggtggaaggcggcgcgaccgtcaaggcgcttcagggatggaaccagcagaacggcaccaacgaagctcagatgagcaccagcaagcagtacgacgacgcttttgtcacccgcacctttgccaataacgacaacgtgccgctggtcaagtttaccgaggtaaagaatacgccgcatgtctaccttcaggaagagagcgaggccatctggaacgacttcttctccaagtacagccgcggcgagaacggcacactctattaccaggccagtgaggagagcgaaaagactgaggtcacaatgagcgaatacgtcgccgacgacggctggtacaaggctgacggcgacgcagaccagaccagcccggacgctgcggcgattcagaagtccatcaccgcgattgcggaaaccgatggctttcagctcgtaaacgtcccgtatgagtgcacgaccaaccacaagaacggcgaagcggtgggcagccatcccttcagctccatgtactgctccgtgggcgacatcgaccaactggccaagcagtatggctttggcgagatggagttcttcatgtcgggcaaggccaacgtatatggcttgtctgacaaggggaccaacgtgccggtcatcaagactgcggacgtggattataccacccgcctgctgatccattaccctgaagatgcggaaaagttttccgggaatatctatgtggatatcctgaatgcctccgccggctatgacctggaggatatcttccgccgcagctacgagcacttcatggccaacggcgacatctacatcggcatcacatccaagaccaccaccgcccaggcgctgaaggacttcgatcctgagcggtacgccgctattgactggctggtggacaacaacgacccggagtccgccgagaacggcctgttttgggatatgctctctcaactgggcaccgtactgaaggaacggcccgaggacatctttggcaccgagttgggccaaaagataaaggacaacggccgtacctacctggtggggcagagccagtccggcttctatctccagacctatttgatggcgttctatccctacatcaacaatgtcctggatggaaaagacatctatgacggctatttcaacgcagtcggctccactccgacgaccctgtccactggtgtaaaaatggaaaatgtgggctggccgaagaccgaggagccctacctggtgctcatgggtgagggcgaagccaaaatgcgtctgtcgtccaactattaccccctgcaggaggacaagagcgaggaggactggaagttccgcctctacgaa

SEQ ID NO: 2487 - DNA, 1752 bp, Unknown
  Artificiall/Consensus sequence
atgtgcggtatcgtcggattcattggaacggaagaggcggcccccatcctgctggacggcctggcccggctggaataccggggctatgactcggccggattggccgtgtacgaccaggtggaggggctgaaggtggtcaaggccaagggccggctgcaggtcctgtcggacatcgtggagggcggaaagaacatccatgggaccgtgggcctggggcacacccgctgggccacgcacggggagccgtcggacgtcaactctcaccctcaggtcagcatgtcggggcgtattgcggtggtccacaacgggatcattgagaactatgttcagatcaaggaatttctggagtccaaggacgttaaatttgtctcacagaccgacaccgaggtggtggcccagcttctggaatactactaccggggcgacatcatggaggcccttaccaaggtgctccaccgcatcgagggggcgtatgccctcggcatcatctgcgccgactgccccgaccggctcatcgccgcccgcaaggacagtccgttgatcctaggctatggcgagggctgccatttcctggccagcgatgtgaccgccgttatcaaatacacccgggaggtatgctatctggaggatggggaaatcgccgtcctcacggcggacggcatcaccgtctacaatcacccctacctccaaccggtggagaaggaaaagcaccatgtggactgggagatctccgccgccgaaaaaggcgggtacgagcactttatggccaaggagatcatggagcagcccaaggccttccgagacacggtatttccccgcatccaggatggccgggtggtgctggatgacctgaacatcgacggagagtacctgaaaaatgccgacaagatttacatcatcgcctgcggctcctcctaccatgtgggtatggtggccaaatacgtcctggaaaaactcctgcgcaaaccggtggaggtgacgctggcctccgaattccgctactgcgatccgctggtgagtgagcggacgctgtgcatcgtcatcagccagtccggtgagaccatcgacaccctggccgccatgcgcgaggccaagcggctgggcgcgcgcattctgtccatcgtcaatgtggtgggctcatccatcgcccgtgagtccgacgacgtactctacacctgggctgggccggagatcgctgtggcgactaccaaggcctactccacccagcttgcggtcatctacctgatcgctctgcggtttgccgagctgctgggcaccatcgggaaagaggaatacgaggatatggtggccgagctgctcaccatccccaccaagatggaacgtatcctggaaaaccgaaaggccatccagtactatgcctccatctacttcaaccacgagtccatcttcttcatcggccggaacatcgactacgccatcggtctggagggctcgctcaagctgaaggagatctcctatatccactccgaggcgtatgccgccggcgaacttaagcacggtaccatctccctcatcgaaaacggcaccctggtggtggcgctggcgagctgtgtccagttgtttgacaagctgatgagcaacgtggtggaggtcaaatcccggggtgccgacgtggtgggcctgacggtggagtccagggggagcgcgctgaaaaagacggtggaccacaccattctggtgccggatacccatcccatgctgctgcccagcctggatgtgatccccatgcag

SEQ ID NO: 2488 - DNA, 1425 bp, Unknown
  Artificiall/Consensus sequence
atgctggaggaatggtctgtgaagaggcgaatttttgtctgccatacgctcaccgtactggcggcgctggtgacgctgctggtggtcagcggcggtgtcatggggtgggtcacgcaccgttatcaggagtggtcccgctcggccatagacgaccgggcggagcaggtacaggcccttctgagcggcagcagcggcacggattgggggcggctggacgctcaactgcgcgagtttggctaccatctacgggtcggccaaaacggtcgggagctgtactcctccctggaccccttccaggaggacgcctaccagcgcttttccgccgacgcggtctggccccccaacggcacacacacgatccagaacgacggaatcctgatgatcggcacgcagaacggcccctatacaatcgtcgccatgtcccgcccccatattcccgaggtcttcggccgccagcgcccccagtccgaagccgtcatgctgtccctgatcaccagcggtctgaccgccatcgtcctgatcgttctgctcagtctgctctttaccaaccaccaggtcaaacagctcatgcgccccgtcaacgccctggccgacgccgcccagcgggtggagcggggcgacctgtcccgtccggtggactaccacggcaaggatgaatttgcctccgtctgcgccgcctttgaccacatgcagcgccatctgctggccgaacgggagaaaaatgccgcctacgagcaggcccggaccgatctggtggccggcatctcccatgatttgcgcacgccgctgacgtcggtgaagggctacatcaagggtctgcgggacggggtagccaacacgccggagaagcagcggcagtacctggacgtggcctaccgcaaggcctgcgatatggacatcctgctccagcggctgttttacttttccaaaatggagaccggaaatctccccctctttccggagcgggccgacctgggcagcttcgtgcgcaggtttgccgaggatatccagggcgagctggaggccaagggcggacatattctggtgcagggcgctcccaccccccaccccgtccgcatcgacaccgagcagatctaccgggtgctcaccaatctgacggacaacgcgcagcgctacgcggggaccactccactggagctcaccctgaccatatggcgggagcgggacaccgaacgtctgcgctttgccgacaacggcgccggggtgccggaggagcagctttcccacctctttgagcagttctggcggggagatcaggcacggggcagccggggcggcgagggcagcggcctggggctgtatatcgtcaagtatatcgtggaggcgcacggtgggaccgtcgccgcacggaacgaccatgggctggtgttcgaaatcgccctgccctgtgaagaggaggtttga

SEQ ID NO: 2489 - DNA, 1815 bp, Unknown
  Artificiall/Consensus sequence
ctgacacgaaagccaaaactggtggtttcgattgcggtcctgcttctgatccccagcatcctgggggccgttgccacccgcatcaactacgatatcctgtcctatctgcccgacgatctggattccgccaagggggaggctctgctggaggagcccttccacatggcggccaccaccatgctgatcgtggaggatatgccccccgagtacaccaaccagctccagaaagaggtggagcaggtccccggcgtcagcaacgccatctggctgtccagcctggtgggcatccagatcccccaggagatgatccccgcggacatccgagacatcttcttctccggcgacgccaccatgatgatcgtccagtacgaccagcccggcgcgtcggaggccacgatgaaatccatcgaacaggtccgctccctgtgcaacaaaaactgctttctggccggcttctccgtctttatcaaagacaccaaggacctgatttcccaggagatgccgctgtacgtactgatggccgtggccctgtccatgatcgccatgtgcgtgatgatggagtcttgggcactgccggtggccctgatgtgcagcatcggcctggccgtgatctataacttcggcaccaacttcttcaagggtgagatctctttcatcacccaggccatcgcggcggtgctgcaactgggcgtcaccatggactactccatcttcctctaccaccgctatgtggaggaggtcccccgccacgcggacaagcgggacgccatggccacctccatcgtggccgccttcaagtccctgtccggcagctccctgaccaccatcgcgggctttttggccctgtgcttcatgcggttgaccctgggcatggacctgggcatcgtcatggccaagggcgtggtgctgggcgtggccaccgtggtactggtgctgccctccatcctgctgcagatggacggcgccatccggaaataccgccatccggctctcaagcccaacttcgaaaagctaaacgccttcgtggtccggcaccggcatttcttcgtggggctcttcctggttctgttcctccccgccgtctattccaacaaccacacgcaggtctactacaagctggaccagtccctgccccaggatatgccctccatcgtggccaccgacaagctcaaggatgagttcaacatggcctcgtcccacttcatcgtgatgcgtgacgacctgagccgggccaaaatgaaggagctggaggagaccatcgacgacatccccggcatcaccagcgtggtggcctacgacaagctcatcagcggggccatcccagacttcttcatccccgacgacgtgaaggagctgtgcaaggcggagggctatcagatgctgatggtcaactccgaatacgtcaccgcctcgaacgaggtctctcagcagctcgccgagctgaccgagctgctccacacctacgaccccggcgcctatatcaccggcgaggccgccatgaccgacgacctcatcaccgtgtccgactccgacttccggatcaccagctatctgtccatcctcgccattctcatcatcgtggcctttaccttccgctccctcaccgttcccatcctgctggtggccaccatcgagctggccatcttcatcaatcagggcatcccctacttcaccggaacggtgatcgccttcgtggcccccacggtcatcggctgcgtccagctcggcgccacggtggactacgccatcctgatgaccacacggttccaggaggagctgcaaaaggggagggaccgcaaggaggccatccagatc

SEQ ID NO: 2490 - DNA, 1452 bp, Unknown
  Artificiall/Consensus sequence
attgacgaggggctctccgccgccaccaccaagaaccgggaaaactttcaccgcatggtggaggacggccaggccggggcctttgacctcatcatcaccaaggagatcacccgcttcgcccggaacaccctggactccatccagtacacccgccgactgttgaacgccggcgtgggggtctttttccaaaacgacaacatcaacaccctggacgaggattccgagctccggctgaccatcatgtcgggtatcgcccaggacgagctgcgcaagctgtccagccgggtgaagtttggtcatcagcaggccatcaaaaaccgggtggtgctgggcaacagccgcatcttcggctaccgcaaggacaagggccggttggtcgtcgacccggaggaggcccccatggtgcgggagctgttccagctctatgccaccggacagtacagcctgaaacagttggagaaccgcttctggacgcagggctaccggaaccacaacggcaaaaagctgtctcacaccaccatgtccggtatcctctccaatccgaagtacaagggctactatgcgggcaacaaggtcaaggtcattgacctgtttaccaaaaagcagaaatttcttcctccggaggagtgggtgctgttcaaggatgaatcgggcactattgtgcccgccctggtggaggaggccctctgggagcaggccaaccaggtgctgaaacggcgtagcgcggatgtccggcaccgccagggcatctgcaaccacgccaacctgctcaccggcaagctctactgcgcccactgcggctccgcctactaccgccgggactctgtcgaccggaccggccgcaaaaacagcaagtgggtgtgcagcggtaagatcaaaaacggcgcggcctcctgcccctcctttcccatctacgaggaggaactcaagccccttctcttccaggtgttccgtcaggccgacgccgacgccggggcgctggtggaggagtatatcgagctgtaccgttctctggagcaggagggcgggctgacccggcacatggaggcgctggagcaggccattgggacggcggaaaaaaagcggcagaagctgctgaccttcaacgctctgggcgagctgtccgaccaggactttctctctatgaaccgccagtgcgcccaggagatcgaagccgcccgggcggagctggaggagctgtccgcccagcgcggctccgcctccgacttcaaatcccacatcgaatctgtacgccggacgctccaggccgcccggcaggaggcatccagcggtctgatcggtaaggaattcgtggaccagtatatccagcgcatcgtggccacaccggaggccgacggttccatgcgcctccagatccaactctttaccggcgagaccaccgaccgttatctgcggaatctgcgctccagtgccgcgcgggatgtgggctgg

SEQ ID NO: 2491 - DNA, 1602 bp, Unknown
  Artificiall/Consensus sequence
atgggagacagagtttgtgagccgatcaccagacgggaagaagtctaccaaagtgcgctggacaccatctattgcgccattattattctggatcaggctggaaagatcctttatgtcaatgagtctgcacggaaaatggtggaggggtcctctgtggtgttcgaggagcttttggagtgccttggacaggaggtagacctggtgcgcggctcggggcgctaccaaatagacgtgggtccggccaggatcgtgtgcagggtgaaccccagatatctgtccggagagcgccatggcagcaccatcgtgctccaccaatccaagcattccgagtgtgtcatgcaggaaatggacgtagtgagcagtatcttcgaggagctcaacgtctgtctggagtcctcccacgacgggatcatggtatcggacggcatggggaacgtgatccggctcaacgccgcgctggagaagctgataggagtcaagcgccgggatatcctgggccggaacgtggccgatctggtgcaggagggcgtgtatgagtcctctgccatcctccaggtcattgagaccgggaagacggctaccgtggtcatcgaccacaacggcaggcaattgctgatcaccggctcgccgggctataatgccaacagcgccatgacggctgtggtggccaacatccgggacatgtccgagctgaacgacctgcgccaaaagctggagcagcagcagatgattgctgagaaatacagcaaggagctggcccatatcgcccggcagcagagcgcgcagaccagctttgtggcctgcagccgggagatgaagaccatcctggccaccatccattccatctctgaggtggactccaccgtcctcatctcgggagagtcgggcaccggcaaggagatggtcgtcaatgagatctatgcctccagcatgcgcagctaccgccccatcatcaaggtaaactgcggtgccatcccgcccgccctgtttgagtcggagctgtttggctatgaggacggcgcctttaccggggcgcgccgcaagggcaagcccggattttttgaactggcccacatgggcacgctgtttctggacgaggtgggggagctcccgctggagatgcaggtcaagctgctgcgggtgctgcaggagggagagatcatccgcatcggcggatcaaagcccatcagtgtggacgtgcggatcatcgcggccaccaaccgggatctgtgggagatgaccgaagagggcaccttccggcaggatctgtactaccggctgaacgtcatcaacatcgaggtgccccctctgcgccagcggcgggacgacatcattccgctggtcatgcatatgctggagcgcttcaaccagaaatacggcaagcacaaggagatccccatcgagctgggcaaggtgctgcgggagctgccctggcgggggaatgtgcgggagctggaaaacctgattgaaaacctggtggtcctctgcccggaggacgtgctgacgccggagcatttgccggtgcggtaccaacgcggccagaacccggcgtcccaggtggagattcgggggattctgcccatgaaggatatggtgcgccgg

SEQ ID NO: 2492 - DNA, 1248 bp, Unknown
  Artificiall/Consensus sequence
atgatcgacatggtgcagggctacgccgcggtcaacgctggtgaggccgaccccaccaccctgggcgtctccgctcccgacgagagcaccttcgtggtcaacctgacctacgactgcccctacttcctggagatctgcgccttccccgccgccttccccgtccgtcaggacatcattgaggcctatggcgatacctggaccaccgacgacaactccagccactatatctccaacggcccctggaagctggccgagtgggttcatgattcctacatcaagatggtgcccaacgagtaccactatgatgccgccaacctgggccccaactctctgaccttccagctcatggaggatcagaactccatgctggccgcctaccgttccggcgacctgcagttcatcgaggatatgcccgtggatgagatcgctggactgctggcttccggcgagctgaacatcgtggattatattggcacctactatgtctgctatcagacccaggccgcgccctttgacaacgccctggtccgccaggcctttactctggccatcgactccaagtatattgtggagcaggtgacccagaccggccaggtgcccgccaccggctttgtgcccgccggcatctatgacgccgatgccaacggcgacgacttccgcaccgtgggcggcgactactgggacgcccctgtggacgacgccacctaccaggccaactgtgagaaggcccgccagttgctggctgaggccggctatcccaacggcgagggcttccccaccgtgacctacctgtataacacctccgacgcccacaaggccgtgggcgaggccctgcagcagatgtggcaggaggagctgggcgtcaccgtgcagctccagaaccaggagtggaacgccttcctggagacccgtaagaagggcgagtaccagatcgcccgcaacggctggatcgccgactacaacgatccctgctccttcctggatatgtggtacaccggcggcggcaacaacgacgcccagtactccaaccccgagtacgacgccatgatcgacgcggccaaggccacgtctgatcccgccgagcgcatgagctacttccacaaggccgaggacatcatcatcggtcaggattgggcgctgggccccatctacttctacacccagaagtacatgatggccgacgacatcagcggcgccttctacacccccctgggctacttcatctacggctactgcaccaagggctga

SEQ ID NO: 2493 - DNA, 1626 bp, Unknown
  Artificiall/Consensus sequence
gtggcgaaatcgaacttagtcattgtagaatctccggccaaggccaagaccatcggcaaataccttggaccggattatcaggtcaaggcgtccatgggccacgtccgggacctgcccaaaagcaagattggcgtggatgtggagcacggcttcgtgccggactaccagcccatcaaagggaaggaggaggtcatctccgacctgaaaaaggcggccaagcagagcgacaaggtctttctggccaccgacccggaccgggagggagaggccatttcctggcacctcaaggagcttttggagctgcccgacgaccgcacttaccgggtcaccttcaatgagatcaccaaaaaagtggtcaacgagtccatcgccgcccctcgggccatcgaccaggacctggtggacgcccagcaggcccgccgcatcctggaccgcatcgtgggctaccagctctcgccgctgctgtggaaaaaaatccgccggggcctgtccgccggacgggtccagtcggtggccacccgtctggtgtgcgagcgggaggaggagatccgggcctttcagccccaggaatactggtccctggacgccgatctcagccgcatctcccccaatctgggggccttcaccgccgccttccacggcgcggagaagaagcaggagctccgcagcgagcaggaggtccggaccgtcagcgacgccgtgaaggcggccccctttaccgtgaagagcgtcaagcgccaggacaagacccgaaatcccgcgccgcccttcatcacctccaccctccagcaggaggccagccgcaagctgggcatgacgccccggcggaccatggcggtggcccagcagctctacgagggcgtggacatccagggcgagggcactgtgggcctcatcacctatatgcgtaccgactccctgcgcctgtctgaggaggccctggcggccgcccgggagctgatcatcagccgctacggcaaggactattatccagacaagacccggcactacaaaaccaaatccggggcccaggacgcccacgaagccatccggccctccgacgtgcgcctgacccctgaggacatcaagaaggatctgaccagcgaacagtaccggctctacaagctgatttggagccggtttttggcctgtcagatggcctccgccgtctatgacagcgtggccatcgaagtggagtccgcgggctaccgcttccgggccaatcactcctccctgaagttttccggcttcaccgccgtgtatgtggagggcaaggacgaggacgaggagaaggtccagtcccccctgcccgacctgaaggagggggaggcgctggtgctgaaggagctcaagcccgagcagcactttacccagccccccgcccggtacaccgaggctaccctgatcaaggcgctggaggagaagggcatcggccgcccgtccacttacgcccccaccatctccaccattctggaccgggagtatgtggtgaaggagggcaaatacctgcgcaccaccccgctgggggatgtggtcaccggcttgatgaaagacaaattccccgacatcgtggacaccgccttcaccgcccagatggaagagcagctcgaccaggtggaggagggc

SEQ ID NO: 2494 - DNA, 1335 bp, Unknown
  Artificiall/Consensus sequence
ctctcccgcatgagccatgagatccgcacccccatgaacgccatcatcggcatgagcgccatcgcggcccagtcggtggggcgcgacgagctggtggccgactgcatcgccaagatcggcatttcctcccgcttcctgctctctctcatcaacgacattctggacatgagccggatcgaaagcggcaagatgctgctgaagagcgaacccatccccaccgaggagtttctcaacgggatcaactccatctgctattcccaggcggtggccaagggtgtggactatgagtgcatcctcgacccggtgctgaacgattgctacattggcgacgccatgaagctccagcaggtgctcatcaatatcctgagcaacgccgtcaaattcacccaggagggtggtaaggtcaccttttccgtctcccaacaccggaggaccaagaacggcgccctgctgcgctttatcgtcaacgacaccggccggggcatcagcgacgacttcctgccccatatcttcgagcccttctcccaggagtccacaggcaccaccgccctgtacggcggcaccgggctgggcctggccatctccaaaagcattgtggatatgatgggcgggaagatcaccgtgcgctccatcaagggcatcggcacggagtttaccgtagatgtcaagctgggcgtcacagaggaggaccggctccgccaccgccccaaaaagcaggactacaacttctcccacctgaaaaccctggtggtggacgacgacgtggccgtgtgtgaaagcgccatactcaccctgcgggagatgggcatccaggccgagtgggtggacagcgggcacaaggccgtggagcaggtccgcgtcctctgggatcggggccggtattacgatctgatcctgatcgactggaagatgccggagatggacgggctggagacggcccggcgcatccgtgccatcgtgggaccggaggtcaccatcatcatcatgaccgcctatgactggaccgccatcgagcacgaagccaagctggccggggtcaatctgctgatgagcaagcccatgttcaaatcctccctgatctctgccttctccaaggcgctgggggagaaggaggagcgcacgcagccggtgcaggagcccgactacgacttcacgggcaggcgggtgctgctggcggaggacaatgcaatcaacaccgaggtggcggtgctgctgctggagagcaagggctttcaggtggatacggcggaaaacggcctgcgcgctctggagatgttcagcaagacggagcagggctactacagcgccattctgatggacatccgcatgcccctg

SEQ ID NO: 2495 - DNA, 1071 bp, Unknown
  Artificiall/Consensus sequence
atgcaaaataattttggtcgttttgttgctcgtcaagtgaaagcttttcttatacaatacattttaggggaagaagcacgttggttcggttacgataggaggttttccgtggaaattcatcatctaaggtatttcgtggaaattgcccgaaacaagagctttactcgggccgcagagcagctttatattacccagcccatgctaacccgggtgatcaaacaattggaagaggagctggatgctaagctgattgagcggaccagcaagagcttccggctgactgacgtgggggaggcgttctaccttcaggcccaggacctgctattgcgctacaatgatttataccggaccattgacgatgtcagatcggttcgcagcggcgaggtacgcctgagcacgccgggggtgctgctggatatgtattttgctccgctgctggcgcagtttcgaaataaatttcccggtattgacattaacattgtggaggagggctctaagctagtcgtaaaagccctactgtccaaccaggcggatttgggaatggttatgctgcctgtcgagcattcctcccaattcgagaccacggtggtggtacgggatcaggtccggctgatggtgggcaagggacaccggctggccggctgcggccaggtccatattcgggaactaaaagaagagcggtttattacatttggtgacacagccacgctgcatgaccaattcatccatttgtgcgaagaacataatttctatccacatgtagcctataaaagtttgatgccgcacttcacagcggaactgctggcctccagcgactgcgtggcagtcatgccgggccctgtgattcagagataccgcaccgatgaattggccgtgctttcgcttgaacagagtcttccttgggaaattgccgtcattcaccgcaaggagtgctaccaatcctatgcctccaacaagctccgggagttcatctgcgactactttgccgccctccagaaggccgcagtccctgttgtcggaacgcccgcgccgcgggaggggcagaacattttttccggtgtttgcgattga

SEQ ID NO: 2496 - DNA, 1269 bp, Unknown
  Artificiall/Consensus sequence
atgcaaatcgcgtacggaaccagcgggataccctgggtgcggagcctggagggcgtggaggttctggagtccgggatcggcgagctgaaggcgacgaagagcgaggacgagctggtgctggaggccatggccaagcccatcgactctcccaagctgtccgagctggccaagggcaaaaagacctgcaccatcatcatcagcgaccatacccgtccggtgcccagcaagcacatcattcccttcatgctcgccgagctgcggcagggcagccccgatatcgacgtcaccctgctggtggccaccggcttccaccgccccaccagcaaggacgagctcatccaaaagctgggcgaaaagatcgtggcggaggagaagatcgtcatccatgacagccaggacccggccagcaacgtggagatcggcgtgctgccctccggggcccggctggtcatcgacaaggtggcggccgagaccgagctgctggtcagcgagggctttatcgagccccacttcttcgccggcttctccggcggccgcaagagcgtgctgcccggcgtgtgcgatcaggtgacggtgctgggcaaccactgcgccaagttcatcgcctccgactgcgcccgcaccggcgtgctggagggcaaccccctgcacatcgacatggtgcaccccgcccggcaggccaagctggcctacatcgtcaacgtcatcatcgacgaggacaagaaggtagtcgccgcctttgccggcaactacgtcaaggcccatgagaccggctgtgcgttcctgaagggctactgccgggtgaagccacagaagcggggcgacgtggtcatcacctccaacggcggcgcgcccctggatcagaacatgtaccagagcgtcaagggcctgaccgccgccgagtccgccgccgctcccggcgccgtgctcatcatctgctcccgctgcaacgacggcaccggcggcgagggcttctaccgggctctgaaggactgcgaatccccggagaagctccaggaggagaccctcaagatccccatggagcagaccaaccccgaccagtgggagtaccagatcctggtgcgcatgatgtgcaagcaccatatcatcttcgtctccgacccctccgccaggcagtttgtggaggacatgaagctggagtacgcccccgacctggagactgctctggaccgggcctacgccctcaagggcaaggacgcccacaccgtggtcatccccaacggcatctccgtcatcgtggaggagtaa

SEQ ID NO: 2497 - DNA, 1362 bp, Unknown
  Artificiall/Consensus sequence
atgggttggatggatcaactcaaaaaggcgggcatgtccatggtgtatggctacctggatcaggacccggaccgcaatcttcccaaactgattgattgggcggaccagttggacacgaaaaatgtctacgggcccgcgcggaaacagtttcgcaaggtgattgaagaccctgagagcaattggtatcagttgatcaagagcctctggacggacattgacgatggagtacgcaggaccctgtttgagaacttcatcgtgaatgccagtctgctgggctatcccaagcagatccagaacagcgagaagtacggctgcaatatcccgtgggccatcctgatggacccgacctccgcttgcaacctccactgtaccggctgctgggcggcggagtacggcaatcgaatgaatatggacctggagacgctggattccatcgtaaagcagggtacggagttgggcacttatatgtacctttacaccgggggagagcctctggtgcggaagaaggacctcatcacgctgtgtgagcgccacccggactgcgtgtttttgtccttcaccaatgccacgctcatcgacgaggccttcgccgacgagatgctgcgggtaaagaactttgttcccgccatcagcgtggaagggtttgagcaggccaccgattcccgccgtgggcagggtacgttccaggctgttaggcgggcgatggagatcctcaagcggaagaagctgcccttcggcgtctcctgctgctacaccagggccaataccgatgtcatcggcagcgaggaatactttgatcagatggtggaatggggcgtcaagttcgcctggttcttcacctatatgccggtgggcaccgatgcagtaccggagctgatggtcacggctgaacagcgcgcgttcatgtaccaccagatccgcaagttccgcgaaaccaagccgatttttactctggacttttggaacgacggggagtacgtgtcaggctgtattgccggtggccggcactattgccacatcaacgccaacggagacattgagccctgtgccttcatccactactcggactccaacatccacaataagaccctgctggaggcctaccgatccccgctgtttatggcttatcggcagaatcagccctttagcaaaaactacctgcgcccctgcccgctgttggataactacggccggctggcagacatggtggatcagagcggggcccattctaccgacatggtccacccggaggacgtccacgacttgtgcgataagtgcaaggaagcatcggagcaatggaagatcacggcggatcaactgtgggcatcctcccacggctgcaccggctgcggcgggcagtga

SEQ ID NO: 2498 - DNA, 678 bp, Unknown
  Artificiall/Consensus sequence
ctggtggcccactgccaggccagaggcatccccgtgctgcccggctgcgtcaacgcctccgacatgacccgcgcggtaaacgctggcctggaggtggtgaagttcttccccgccgagcagtccggcggcctgagctttctcaaggctctggctcccgtgtttcccaagctgagctttatgcccaccggaggcgtaagcgccaagaatctgatggattatctgggctatgaccgcatcgtggcctgcggcggcacctggatggtaaagaaagacctgattgaagcagagcagtgggatgagattacccgggtgtgcagagaggccgtaaagaccatgctgggcttttctctccaccacgtgggcatcaactgcgccgacgaggcagaggccgaccgcaccgtccggacgctgtgcgccctcttcggctttacctatcaaatgggcaactcctccatcgtggccatgcccgccgtggagtgcaccaaacagccctacctggggactcacgggcacatcgccatcggcgtcaacagtgtggatcgggcggtgtatcacctgggactccagggcgctgccttcgacgaggccacccgcaagaccgacgctaagggccgcaccaaggccatctatctccagggtgagttcggcggatttgccattcatctggtgcaaaaataa

SEQ ID NO: 2499 - DNA, 1044 bp, Unknown
  Artificiall/Consensus sequence
atgttcaagaaatttaccaatggctgcgtacgcgtggtcaaccgctggctgccggatgcattcctgtttgctatcattttgaccatcgttacctttgttggctccatgatcggcaccaagcagtcccccattgaactggtcaatgcttggggcaatgataagggcatgtggggcctgctgtccttctccatgcagatggccctggtcctcgttctgggctccgccatggcctccgccaaggtctgcaaaaaggcgctgggctccattgcaagtctggctaaggacaagaaaagcgccattgttgtcactaccttcgtctctaccatctgctgctggctgaactggggctttggcctgatcgccggcgccctgctggccaaggaagtggcccgtcgggtccgcgacgtggactacgccctgctgattgcctccgcctattccggcttcgtcatctggcacgccggcatctccggttccattcccctccagatatccacgggaagcgagatcctgggagtcgtctatcaggtgcccaccagccagaccattttccatcccatgaacctgctcatggtcggcgtgattctggtcctgatgcccttcgtcaactatgctatgcaccctgatgtacagcacaccgttaccgtggaccccgcccggctggtcgatgaggaggatcggacctacaccatcagcccccccgccgaaaaattggagcacagcaaagttctctggatcatcactctggtgttgggcttcgcttacatcatctattattttttcaccagcggcttcaacctgggtctgaacatcgtcaatatgattttcatgttcctgggcattctgctccacggcgacctgcgtaaatatgtggacgccatcggtgatgccgcctccggcgccgccggcatccttcttcaattccccttctatgccggtatcatgggcctgatggtggcgcccaacgccgacggcgtatccctggcctctatcattgccgacttcttcgtcagcgtctccaatgaagtcaccttccccatgctg

SEQ ID NO: 2500 - DNA, 1524 bp, Unknown
  Artificiall/Consensus sequence
atggcagagagaacgcgcaaaacagaatcccggtccggtgaccgccgggccaaccggaccatcctgggccgcaccattttcctgatggtgatcttcggggtggttgtctttatcccgctgttctggaagttgtgggacgtgcagatcagccagcacgacaagctggaggagcaggccatcgaccagcagacccgggacctgctggtgaccgcgccccggggcaccatttacgacgccaaaggcaaccggctggccgtctccgccgacgttcacaacatcgtcatctctcccaaggacatcgtggagggagagaaggcggcggccgagcgggcggcggtcaagctggaaaagggcgccggacttacccaggaggagaaggagaaaaagggctgcgtccccaccgacgccgaaattgccgcccagagcggcaattacgccgcattcatcgctcaggggctgtcccagatcctgggggtggaggaggaaaagatcctcaagcgcatggagaacaccgcggtccagtatgaggtggtcaagtggcgggtggaggacgacatcaccacccaggtccggcagttcatcagcgactatcagctctaccccggcgtgtatgtggagccggacaccaagcgctactacccctcctccgatctggccgctcatgtggtgggctgggtcaacgtcaacgacaacaacaagggcgcctacggcgtggaggcccagtacgagagctatctggccggaaaggccggccggggggtcaccgccaaaaacgccgccggcaccgagatgctctccagctatgaaaactacatcgacgccatcgccggcggcgacctgcacctgaccatcgacaacaccatccagagctacgcccagcgggtcatggacgagggcattgccaaatacgatgtgcaggagggggccttctgcatcgtcatggaccccaacaccggcgcggtgctggcgatggcctccagccccgactacgatctgaacagcccacgggagatcaccgactcagtgctgtccagctacgtggagtcggtgaggaacgaccccagctccaacgacgaggcctatgccaaagcccttcaggacgcgcagtattcccagtggcgcaacaaggccctcaacgacacctatgagcccggctccaccttcaagaccctggtcctctccgctgccctggaggagggggtggtcagcgagtccgaccacttctactgctccggcgtgaagcaggtggccaactggcccatccgctgttccaagcgggagggccacggagatcagaccctgcgccaggcggtgatgaactcctgcaacccggctttcatcgagatcggccagcggctgggggcggaaaagttctgggagtacctggagaactacggcctgatggagcgcaccggcatcgacctgcagggcgaggggcagagccagttctgggacgaggaggagttcgtcagcgaacagggcatcgcctccctggccaccgcctccttcggccagcggttccag

SEQ ID NO: 2501 - DNA, 930 bp, Unknown
  Artificiall/Consensus sequence
atgtataaattcatcctgctgtttatcgctgctgagctgctgacggcggtgattctggaccatccggccaacatcctgccgggactggtcaaaatcatcacgatgcaggatgtgctcatcaccgactatgtccagatcgccggaccgggggccgccttggtcaactccgccctggtgactctggtcagcaccgtcatcctctatctctgcaaagaccccctcaacggcttcaccattgccctcatcggcctgatgtccggcttttccctcttcggcaagaacattgccaacatctggcccatcatcctgggcacctggacctatgccaggcgccggagggagccctttggtcagcacgtcaatgtggcccttatggccaccgccctgtcgcccctcatcagctacatggctctgggcagccagcacgccaacctcctagtgggcgtcctcatgggcatggtcatcggaggtgtgctgccctctctgtcggcctatacctacaaggtccagaacggcatgaacctctataacatgggctttgcctgcggcatgctggctatgatgatcgtccccatcctcaccgccgctggagactcccccgagaaggtcatgtactgggccaccggctacaacacgaaattcaccgcggccctgtgcatcctgtgcggcgttctcattttttcaggattgttcctgtgcggcaagcccgcctgggccgcatgggccggctaccgccgcctgctccttacctccggccgtgcccccagcgactacctgcgtatgttcggcgctgcccccgtcctcatcaacatgggggtcaacggcctggtggccaccgcgtacatcctgctcatcgggggcgacctgaacggcgccaccctgggcggcatcctcaccgtcatcggattttccgcctacggcaagcacgcc

SEQ ID NO: 2502 - DNA, 1125 bp, Unknown
  Artificiall/Consensus sequence
atgtccaaagaactcatccgcttgtcggattgccgcatggtgttcgacgacgaggtcgtcctgaactccatcaacctgtatatcaatgacaaggaattcctcacactgctcggccccagcggttgcggcaagacgaccaccctgcgtatcatcggtggttttcagaagcctacctccggggatgtgtttttcgacggtgtgaggattaatgatgttccgccgcaccggcggcaggtgaacaccgtgtttcagaaatacgccctgttcacccatatgaacctctttgaaaatgtggccttcggccttcgcattgccaaggtgccggaaaaagagattgagcgccgggtcaacgaggccctggaactggtcaacctgcccggctacggcaagcggagcgtggactccctctccggtgggcagcagcagcgcatcgccatcgcccgggccattgtaaaccgcccgcaagtgcttctgcttgacgagcctttgggcgccttggatttgaagctgcgcaaggacatgcagatcgagctgaaaaagattcagcagcaggtgggcatcaccttcgtctacgtcacccacgatcaggaggaggccctcaccatgtccgacacggtcgtcgtcatggataagggcaacatccagcagatcggctcccccatcgacatttataacgagcccaagaacgcctttgtggccgacttcatcggggagtccaatatcatcgacggcatcatgcacgccgacggtgtggttgggatgtacggaaagaaatttccctgtctggacggggggtttgctcccaacgaggcggtggacgtggtcatccggcccgaggacatcgacatcgtctctgaggaacagggccagctcaccggcacggtcaccgaggtcaccttcaagggaatgcactacgacatcatcgtggatttccggggcttcaagtggctcattcagaccacggatttctcccctgtcggagccagaatcggcgtcaagatcgaccccgacggcttccacatcatgaaaaagagcgcctattccggcaagttcggagactacagctcctacagcgacgagtacgatgagctcagcgaggatgcggaggcgggcgatgaagagtaa

SEQ ID NO: 2503 - DNA, 1635 bp, Unknown
  Artificiall/Consensus sequence
atgtttcgttcgctgcatatgaagctggtgctcatcatggtgctgcttatcctgtcgctgatgacggtggtgggggcttttttgatgaactccgtggtgcgcttctatctggacgacttctacgtccagatgcaggatgtgttcggggatcaggtcttcctggacgatctgcagacccccacccaggacgagctggaggggcgcgtcgagccggtggacatgctcaaacaggtcctcaattctaatatgggccctctgggcatcgacaaccgtacccgctattactatatcctggacagtgccaccggcgcctacctgaccagctccgacgatgccgacaccctgcgggaaaagacccccaacatcacccatgtggtcaacgcgctggcccagggcgagctgaccgaggtgggcagcgacagcgacatcacggcttcctacatggacctggcggtccccgtccggcggggggacagcagctatatcatctacatctacgactcccgccagaccatctccgagctgaatgcatccctgttcaccatcatcgtggaggccctggtgttcggtctgatcatttcggtgctgctctcctttctgctggccaagaccatgaccacccccattgaacggctcaccgacggcgtaaagcgggtggcctccggcaacttctcccggaagatcgaggtgggctcccgggacgagatcggcatcctcaccggcaacttcaaccacatggcccggaagctccaggacaccatacaggaggcggagaacgagcgcaacaagctggataccctgttcctccacatgaccgacggcgtggtggccttctcccggctggggctggtcatccacaagaacccggcggccgaggagatgctgggccgccccatcggtgagcagacggcctacggcgcgctgttcggggacattgcctctctggagcaggtgctggccctggaacagccggcctacctgtccggcgagcgggaggcggccgggcggaccctggagctgctgctggctccctttgacggggagcggcaggaggggggcgttatggtggtcatccatgacgtcaccgagcagcgcaagaccgaggagctgcgccgggaattcgtggccaacgtgtcccatgagctgcgcacccccctcaccaacatccgctcctacgccgagaccctggccgacaacgccggggatctgcctccggagaccgagaagaacttcctgggggtcattctcaatgaatccgaccgtatgacccacatcgtgcaggatctgctcaccctgtcccggttcgattcaggccggagcgagttcaagctggcccggttctccttcgagggggccatccgggatatgtatcacgccgtgctcatggaggcccagcgccacgggcataccgtagcgctggagctggagcccaaccttcccggcatcgtgggggaccgggagcgcatcctgcaggtcatgatgaacgtcgtctccaacgccatcaagtacacccccgacgggggggcgatcggcatctccgccggccgggcgggagagaaggtgtggatggaggtgtccgacaacggcatcggtatcccaccggaggaccgctcccgcatttttgagcggttttac

SEQ ID NO: 2504 - DNA, 1263 bp, Unknown
  Artificiall/Consensus sequence
gcaagaagcctgcaaaacagttgtatcgacccggacgactatgtgcgctacgacgtcaagcgcggcctgcgcgacctgaacggcaagggcgtggtagccggtctgaccgaggtctccgagatcgtctccaaccaggtggtgggcggcaaaacggtaccctgcgagggtcagcttttctaccgcggctacagcatcgaggacctggtccgctgctccctccaggaaaaacggttcggctttgaggaggcggcctacctgctcatgttcgggcagctccccacccgccgggagctcgacgacttcatggaccagttggcctcctaccgcaccctgcccaaaaactttgtccgggacgtgatcctcaaggcgcccagcgccgatatgatgaactccctggccaaatgcgtcctctccatcgcctcttatgacgacaagaccgacgacatctccctgcccaatgtggtgcgacagtgtatgcagctcatcgccaccttccccctctactcggtgtacagctaccaggcatacaactacaaagagggcaattctctctatatccacgcgcccagccccgagttgtccactgccgagaacattctctccctgctgcgcgccgattcctcctactccttctgggaggcccacattctggacatctgcctgatgctccacgccgagcacggcggcggcaataactccactttcaccacccacgtggtcacctcctcgggcaccgacacctactcctgcatggctgccgccctggcctctctcaagggccccaagcacggcggcgccaacatcaaggtcatccgcatgttcgaggatatgaagcagcaggtgaaggactggaacgacgaggacgaaatcaagcgctacctgaaagccctcctccacggagaggcctttgaccgggccgggctgatctacggcatgggccacgcggtctactccctgtccgaccctcgggccaacattctgcgctcctttgtggagaccctgtcccgggagaagggccgtactgaggagtacgggctctattcccgggtggagcgtctggcccctcaggtcatcggggacgagcgcaggatctataagggcgtggccgccaatgtggacttctattccggctttgtctaccacatgctggacctgcccctggagctctacacccccatctttgccgtggcccgcatcgcaggctggagcgcccaccgcatcgaggagctcatcaacatgggcaagatcatccggcccgcctac

SEQ ID NO: 2505 - DNA, 1212 bp, Unknown
  Artificiall/Consensus sequence
atgtccgagcagaccaagtcccgctccgcctcccagggcaccctactttggcggatcagcaagaagttcaactttgccgccgagaaaatcattccggattcctttgtattctgtgtcatcctgatgctcgccgtctttgtcctgtccctgctgctctgcggcaagtcccccctggatctgttgattgcctggtggaacggcctgagcagccagttcaccctggccttccagatgggcctgatggtcattgtcacctccacctgcgcccgcagcccccaggccgcgaagctgctcaacaaaattgccagtctggtgaacacccgcaccgccgccctgatcgtgctgatgatcttcggctatgtgacctccatgctcaactgggccttctgcaccatcgtcactcccattctggccatgcacctcgccaagcgcatcaagggcctccacttccccatgatggtggccggcggctattcctgcatgatcctgggccagtgccttgggccctccgccactctgtactccaacctggccaccgagggcagctcctatgctgaaattgtgggccagtctatgagcgtagccgaaacctgctacaaccccatgaacatcatcctctgggtcgtgctggccgtagtgtttatcctgctggtcctttttacccgtccgggcgagcatgagctggtggagctgggcaacatcgccaccgaggctgacgtggagcccgagtcctacaagagcaccaagaagcccgagaatgcggccgaacacatgaacaccttcaggcccttcatgtggatcaccggagccttcatcttcttctacattgtctactccgtggccaccaagggcctgctgggcgcactgaacatgaatctggtgatcttccttttcgtgggcatcaactgcttcctgttccccgagccccaccagtggatcgaggcccacaagaacagcatgcacctggccaccgacgttatgcttcagttccccttctacggcgctatcatgggcatgatgtacctggacggcggcctgggctccgtgctcatcaacgccatggtctctgtggccaacgcccagaccctgcccattttctccttcctgtccgcctgcctcgtgaacctgttcatcccctctcagggcggccagtttaccgtgcagggtcctctgatcgttgcggcggccaaggccattcccgacgccaacctg

SEQ ID NO: 2506 - DNA, 1734 bp, Unknown
  Artificiall/Consensus sequence
atgaaacacgtttttctttttcaaacccataccgaccccggctggtccccgggcaggcgggccggcttctggctgtggaacctgttctgggtggcggccgccagcctctgcgtggggacgctgagcctgtactttgccgcggtgttcaagcaggccgagctgtttggaagctacttcaaaaacccactcattgccctgctgaacctggcccccgtgctgctgctggccctggggctctacttcctcaccgggcggcccggcctggcctacggcctcaccgccgggctcaccgccggctttaccatgggcaactggtttaagctccagtttcgcaacgaccccctgctcttcgaggacctgctcctgctcaaggaggcgggcaacatggcggggaaataccagctcttcctctcccgcaccatggccctggccctggccctgctgctgctgggcggagtgtttttccacttctgcgtccggggcaggctgaagggacagacccgctatcgttttctgggtatctccgccgtcattctggcggccctgcccctccaggaggccatcctcagcgacagcgtctaccaggaccgcaccgccaacaacgacctcatcaaccgctggtcggctacccaggtctacgtctccaagggcttcgtctacccctttctctacagcgtcaagtcggcctccgacgcgccgccggagggctatgatgccaagcgggccgaggctatgctgaacgcctaccaggacgccgacatcccggaggaccaaaaggtgtccctcatcaccatcatgctggaggcctacagcgacctgtccggctttgacatccccggcctcagcgaccgggtatacgccgactaccacgccctggaggccgagagctacaccggaaatctcatcaccaacatctttgccggcggcacggtggacaccgagcggtgttacctcaccggcttctcccggctgggttccttccgctcccccaccaactcctacccctggtacttccgctcccagggctactccgtgctgggagcccacccctgcttctcctggttctacaaccgggaaaacatcaaccgcaacctgggctatgaggactactggttcgtggagaaccacttcgcacccctcaccggcggggacgtgggctacgacaaggtgctcttccccgaactcatcggcatgtgggaggagaaccggagcaccggcaagcccctgttcgcctataacctgacctaccagggccacggcccctacgacgccgacgtgacctggtggggggacgattacgtcaccggcggggactacaccgacgccgagcggaacatcctcaacaactatttcggctccatctacgacaccaaccagcacctgacggagtttttcgactactaccgccaggccgaggagccggtggtcatcgtcctgttcggggaccacaagccctggctgggggacggcaactcggtgtacgagaccctgggcatcaacctggacttctccaccgaggaggggttctaccactattacgccacccgctacctcatctgggccaacgacgcggccaaggatgtcctgggaaataacttcacgggagagggcccggatctgggcccctacttcctgatgaaccaggtgttccggctgtgcggctgggaggggcccgcctttgtgcaggccacccagcaggtgatggaccgggtgcccgtccacaacacccccacc

SEQ ID NO: 2507 - DNA, 1134 bp, Unknown
  Artificiall/Consensus sequence
atgaactggaaaacttattatcaggaacatctgaccacggcggaaggggccgtgaaaaaaatcaagtccggcgaccgggtggtggtcgctcacgcctgcggcgagccctcccacttgctggaagccatggtggccaacgccgatgcctaccggaatgtggagattgtccatatggtggccatgggcaagggcgagtactgcaaaccagaatacgctgacaacttccgccacaacgcttttttcgtgggcggaagcacccgggacgccattgccgaggggaggggtgattttacccccagcttcttcttcgagattccacggcagttttccactaccatgcccgtggacgtggctatggtgatggtaacgcctccggacgagaacggcatgtgttccctgggtgtgtccgtggactacaccttggaggccgtcaagcaggccaagctggtcatcgctcaggtcaatccccaaatgccgtggaccggcccccacagcctggtgtcggtagacgagctggattgcatcgtggagtatgaagccccccttatcgaactggcgccccccaagatcggcgaggtggagaaggccatcggcgagcactgcgcctccctcgtccccgacggagctaccctgcaactgggcatcggcgccatccccgacgctgtgctcctcttccttaagggcaaaaaggacttgggtatccactctgagatgttctccgacggcgtggtggagctggccgaagccggtgtcatcacaaacgcccaaaagaccctgaaccccggcaaattcgtggtggccttcctcatgggcaccaggcggctttacgactttgtggaccacaacccagacgtggagctgcgtccggtggattacgtgaacaatccttttatcatcgctcaaaatgacaacctgatctctatcaactcctgcgttcaggtggacctgatgggccaggtcgcctccgagaccatcggccccaggcagatctccggcgtgggcggccaggtggacttcgtccggggcgcctccgccagcaagggcggcgtgtccattatggccatgccctccaccgtcaagggcaaggtctccaaaatcgtccccctgctggacgagggggccgccgtcaccacc

SEQ ID NO: 2508 - DNA, 1233 bp, Unknown
  Artificiall/Consensus sequence
atggcaatcctgccggggggcaagcatatttataatgtgacgcatcagatcaaaaaggcggtcaaggagaccctgctgccttgcagcatgtttgaggacatgggctttacctatctagggccggtggacgggcacgacgtgcgcggcctgacccgccttttgagctacgcgcgggatttggaaacgccggtcctgctccacgtcagaactgtgaaggggaaagactatccacctgctgaaaagaatcccgatgcgtttcatggggtatccaggttctgcatccagaccggagaggcccttcagccctccaggcccagcttctcaggtgcctttggagccgccatgtgcgctctggcagagcaagaaagccgcctgtgcgccatcacagccgccatgcgggacggaaccgggctgaaggaattttcacgctgccatccggaccggtattttgatgtagggattgcagaggggcacgctgtcgcaatggccgccgggatggccaaggagggggcggtgccggtgctggcggtctattcttccttcctgcagagagggtatgacatgctgctccacgatgtgggcattcagggcctgcatgtagtgtttggcgttgaccgcgctggcctggtgggagaggacggtgagacccaccacggcctgtttgacgtggcctatttggccacggtacccgggatgacggtgctggcccccgccagctttgccgagttgcgctccatgctgttccatgcggtccgggaagagaaggggccggtggccctgcgctacccccggggaggcgagtccacctatcattcggaccactggggcgaaaagacagtgatattggaggccggacaaggaattacacttgtcacatatgggacgctgaccggcgaggttctgacggcggcggagcggctgaggcaggatggatactccccggaggtcatcaagctcaaccagatccacccgttggattggaagccggtgctggcctcggtcacccgtacgggccgccttttggtcgctgaggagtgcgccgccatgggctgtgtgggagagcgaattgccgccgggttggccatggcgggcctggccccccgagccatggcactgtgcaacaccggagcgcattttatcccgcaggggacggtggcggaacagaaaaagctctgtgggctggatgtcagctcgctgtatgagagggcattggaggtcttgcggcgtgggtaa

SEQ ID NO: 2509 - DNA, 1245 bp, Unknown
  Artificiall/Consensus sequence
atgattgccgctcttgtgatcctcgtgatcctctccgcctttttctccgccaccgagaccgcctttacctcgctcaaccgcatccggctcaagagccgggcggacagcggcaacaagcgggctgccctgaccctgcgcatcgcggaggactacgacaagctcctgtccaccaacctgatcggcaacaacatcgtgaacatctcggcctccaccgtgggcaccgttttgttcaccaagctgtttttggactacggtccgctggtctccacggtggtgctgaccgtggttattctggtctttggcgagatctcccccaagagcatggccaaagagaacgccgaggcctttgccatgttcgcagcccccatcatgcgggtgctgatgacggtgctggccccggtgaactacctctttgcccagtggaagaagctcctcagccgcatcttccgcaagtcggaggaggagggcatcaccgaggaggagctcatcaccatggtggatcaggccgagaacgagggcggcctggaccagcatgaggggcagctcatccgctccgccatcgagttcaacgacctggaggtggaggagatcctcaccccccgggtggacatcgtggccgccgaagacaccgccaccatggacgagatcgccgccatcttcgcggaaaacggctactcccggctgcccatctaccacgacaccatcgacaacatcatcggcgtcatccacgaaaaggacttccatgccgcccgctaccacggccaggaggacgtatccgccatcgtcagcaatgtgctctacaccaccggcagcaccaagatctccgacctgctgcgcatcctccagcgggccaaggcccacatggtcattgtggtggacgagtacggcggcaccgaaggcctgtgcaccctggaggacatcgtcgaggagctggtgggcgaaatctgggatgagcacgacgaggtcatcgaggagttcaaaaagcagtccgacggcagctacctgatctcctgcaacgccaacctcaccgacctgtacgatctgttctccatcaagggcgagcgggactgcaccacggtgtccggctgggtcatggaggagatcggccgggtgccggaggagggggatcacttcgtctatgagaatctggatgtgaccgtcaccagagtggaccaccgccgggttctggagatccgggtggtagtcctgccccaggaggacaccggcgacaaggaccgcaagtaa

SEQ ID NO: 2510 - DNA, 870 bp, Unknown
  Artificiall/Consensus sequence
gcctccatgggcggctcccaggtctacctgaaggagggggagcagatgaccgtccatgatatgctcaaggcggtggcggtggtgtcgggcaacgacgccgcagtggccctggccgagcacattgccggcagcgaggagggctttgtggagcggatgaaccgccgggcggcggagctgggcatggccgatactacctttatcaactgcaccggactgcccgccgccggccacctgacctccgcctacgacatcgccgtcatgtcccgggcgctcctggcccaccccggcatccgggagttcaccaccatctggatggactccgtccgggacggccagttccagctcgccaacaccaacaagctcatccggttctatgaaggggccaccggcctcaagaccggcttcaccgattccgccctctactgcctgtcggccaccgccgagcgggacggcatggagctcattgccgtggtgatgaagtgccctacctcggaaaaacggtttgaaggcgccaaggccctcctgaacttcggcttcgccaactataccctcctggacgtccacccggaccaggcgctgccgccggtggaggtggccctgggcgagtgctccaccgtccagcccgtgctggcccagtccggccgtattctgatcgacaaggccgagctcaacaacgtcaccaccgagctgcgcctcaccgagcgggtggaggcccctgtggtggccggacagaagctgggagagatggtggtctcggtatctggcgtggagcagcagaccatccccgttgtggctgaccaggctgtggagcgcctgaccatgcccggcatctttaagcgattcctggacatcctgtttatggccggatag

SEQ ID NO: 2511 - DNA, 867 bp, Unknown
  Artificiall/Consensus sequence
tctgtggtgggtgtggtctacacccccgcctatgtggtcagcgtggacggcgtggacctgggcctggtgaaggagccccaggtcttcgagcaggtcatggaccgggtggaggcccgcgcctccaacattctgggctatgattacaccctccagaaccaggtgggctacgagcgtgtgctggcggagcgggaggatctgtcccccatctccggctttgagacctatctgttcagccaggtgggcgaggtgatgaagagctatgtcctcaccgtggacggccaggctctgggcgccgtcaccgaccgggcccagatcgaccagatgctggacgaaatcgccgccccctacgtcaacgcagacaccatctccgtcacctatgacaaggctgtgggcgtctccctggagtacaccccatccgagtccatcaaggatatctccgagatgaaggccgctctcaccgccaacaccagcggccagaccacctatgaggtccagaagggcgacacctttatggccctggccttctccaacggcatgaccatggccgagatggaggccctcaaccccggcgtggacatcaacaagcttcagatcggccagctcctcaacatcaaggaggaggtcccctatctgtccgtgcagaccgtggattccattacctacaccgaggagatcccctgcaccgtgcgggaggtggaggacgacaccatgtaccagggcgagtccaaggtcctggaccccggcgtccccggcgaggctctggtctccgccaacgtgacctatgtcaacggccatgagcgggaacgggacatcctcagctccaccaccgtgcgggaggccaccgagaaggtggtagccgtgggtacc

SEQ ID NO: 2512 - DNA, 1362 bp, Unknown
  Artificiall/Consensus sequence
atgccggaacctgatatcgcccgctacaagtacattttggatgagatcctgcgcctgaccgacgacggcttcattgtggtggacccccagggcgtggtcactgacatcaacgagcagtactgcgacttcctgggccggacccgggacgaggtggtgggctatcccatcactaaggtcatcaagaactccaagatgatcgacatcgtccgcaggcggtacagcgaggagctggccctccacaagtacgtcccgggcgacaccaaggccaacgacgacaacttcgtgctggtcagccgctcctgcgtctttgacgacgccgatcaggtcgtggctggtgtagcccaggtgaagttccggctccaaaccctggactcggccaaacgtctgatgagcgagtacgccgagttggaattttaccgggaagagtaccagaactacagcggcaaccagtacagctttgagcacatcgtgggcagcggcgagcgcttcctggaaaccaagcgggcagggctcaaggcggccaagaccgactttgccgtcctgctcacgggtgagacgggcaccggcaaggaggtctttgcccgggccatccacaacaacagcccccgttccgacaagcccatggtcagcatcaactgcgccgccatcccctccgagctgctggagtcggagctcttcggctacgccgagggggcctttaccggggccaaaaagggcggtaaaaagggcaagtttcagatggccaacggcggcactctctttctggacgagatcggcgacatgcccctgcacatgcaggccaaaatcctgcgcgtccttcaggagggcgaggtggagccggtgggcggctccggacccgagccggtggacgtgcgcatcctctccgccacccggaagaacctgaccgagatgatccagcggggcgagttccgggaggatctctactaccgcctgaacgtcatcaatattgagatggtgcccctgcgccagcggcggggggacatcctggagctggccaactactttctggcccggctgaacaagacctaccaccagtccaccgtcctctccggcgaggtgaagcgttgcctgatgaactaccagtggccgggcaacatccgggagctggacaacgtcatcaagggggcctacgccacctgcgacggcttctccatcgacatgatcgacctgcccgcccgtctggccaacctgcagaagggagccggaccgggtgcggagggctccaaaaagctggccgagctgatggacaactacgagcgggagattatcaagtccaccctgcgggcgacgggcggcaactgccagcaggcggcggaggaactgggcatccatcgcagcgcc

SEQ ID NO: 2513 - DNA, 1308 bp, Unknown
  Artificiall/Consensus sequence
tcctttatgcgctccctgagcaccgcctccaccaccctggggcagcagaacgattacgccgtcaacatcgacactctggccaaggtctccgactcttatgtcattgtcaccgagaccgacggcctgatcttttattcctccgacggcagcgacgggtccaacctggccggcggcgtggtgccctcctatatggtcagccaggtggccgccaccgggagctactccggcatgaccgacctggggggcatctttccggaaaagcggttcgtggccgggacccccatcctggtgcagaccattgattttaagaccggccagggcctggtggtgcaggataagctgttcggcatggtctttgtggccgccgagactgccagcctgactgagatgtggcgggccttcgccagcatttttttcttcacctccatcgtggtgctgctcatcgcctttatcaccagctcggtcacctctctgcggcagaccaagcccctgaaggagatggccgaggccgcccgcaagtttggccacggggagtttgacgtgcgggtgagcggctcctgcgaacgctgcgacgaggtgggggagctggccaccgccttcaacgccatggcggactccctggccaagtccgaggcccggcgcagcgaattcgtggccaacatctcccatgagctcaagacccccatgaccaccatcgccggctttgccgacggcatcctggacggcaccgtcccgccggaaaagcaggaggccgccctcaagaccatctcctccgagacccggcggctgtcccgcctggtgcgccggatgctggacctgagccgccttcagtcggccgagcacgtgaccgcccaggagcagttcgacgtcagcgagatcatgctgcgggtgctggtgagcctggagggcaagatcaattcccgccatctggacgtggacacccagctccccgaggagcccgtcaaggtgtggggggatccggacgctatcacgcaggtgtgctacaatctgctggataacgccatcaagttctccgccgagggagagaccctgggcatcggcgtggcggccaaagggggaaaggcctacatctcggtgcgcaatgtgggtgagaccatccctccggaggagctgccgctggtctttgaccgcttccacaagaccgatcactcccgcagcgaggaccgggagggcgtggggctggggctgtatatcgtcaagaccattctggacaaccacaaagaaaacatctctgtcaccagcgaaaatggggtgacggaatttacctttacgctgacgcaggcctga

SEQ ID NO: 2514 - DNA, 1044 bp, Unknown
  Artificiall/Consensus sequence
atgcttcccctggaagtgctcgaaagagcgggggccgaaatcaccaactatcagggttccggcatgtcagtcatggagatgagtcaccgatctaaggtgtttcagaagatctttgacgacacccaggccaagttccgccagctcttctgcgtgccggaggggtacaagatcctcttcctccagggcggcgcgtccagccagttctccgcggctcccctgaacctgatcggccggaccggaaaggccgactacgccgtcaccggcaacttctccaacatcgcctataaggaggccaaaaagtatggcgccatccgtctggccgcctcttccgaggaccgcaaccacacctatatccccacccaggaccagctccagttggaccccgaggcgtcctatttctactactgcgccaacaacaccatctacggcaccgagtggcagtacgtccccgacaccgggtccgtccccattgtatgcgacatgtcctcggacattctctcccgcccggtggatgtgagcaaatacggcgtcatcttcgccggcgcgcagaagaacatggcccccgccggcctgacggtggtcatcattcgggaggatctggccggccacgagctgccctacacccccctgatgatgaactacaagaccatgatcgacaaggactccatgtataacacgcccccctgctggtgcatctacatgctgggcctggtgctggactggctggaggcccagggtggcgtgcccggcatggaggccatcaagcacaagaaggcccagatgctctacgacgtgctggaccgctccaagctcttcacctgcgccgccgaggccggctcccgctccgacatgaacgtgaccttccgctcggtgagcgaggagctcaacgacaagttcgtccaggaggccgccgccgccggcttcaccaacctgaagggccaccgcaacgtgggcggcatgcgcgcgagcatctacaacgccatgcccaccgagggcattgagaagctctgcgacttcatccaggactttgacaaaaagaattaa

SEQ ID NO: 2515 - DNA, 1329 bp, Unknown
  Artificiall/Consensus sequence
atcctgatcgtccccatcttcggcggactgttctacatcatgtttggaggaaaccgcctgagcagccgcacccggcggcggatgcaggggctggagcggaagatggaggaggttctccgaccggatttccaggccgatgagctgctgcccattggggaggacgccgtccaccaggcccgttatctggagcatatggcccactgccccgtctacggcaatacggtgacggagtatttttcgctgggcgaattctgctttgcgcgcatgatcgaggagctgaaaaaggcggaacgctacatttttgtggagtatttcatcgtcgaggagggcgagatgtggaacgccattctggatatcctcaaggagaaggcggcccagggggtggacgtgcgcttgctctatgacgatatcggctccatgttcaccctgccccgggactacgccagggacctggaggccaagacgggcatcaagtgctgtgtgttcaacccctttgtgcctatcctgaccatccggctaaacaaccgggaccaccggaagatcatggtcatagacggcaaggtgggcttcaccggcggcatcaatctggccgacgagtatatcaacgccaaggtgaaatacggccactggaaggacagcgccattatggtccggggggatgcggcctggagcatggcggtcatgtttctgaccctctgggacgacgtgcgggagaccctgacggaggactatgaccagttccggccggtctgggctcccggcgagaagccggagggcacccagggctttgtgcagccctatactgacaaccccctggatggggaggcggtgggccaaagcgtctatctcaacctgatcaacaaggcccgcaagtatgtctatatcaccacgccctatctgatcgtggataacagcatgaacaacgccctgtgcatcgccgccaagtccggtgtggatgtgcgtatcatgaccccccacattcccgacaagagagcggtctttgagcttacccggtcccactacgagcccctgttggaggccggggtgaaaatctatgaatatacccctggctttgtccacgctaagaacttcgcggtggatgacgaatatggtacggtgggctccatcaatttggactaccgcagcctgttcctccactttgaaaacggcgtctggctgtgcagcgaccccagcgtgctggatatcaaggcggattttctggagacgctggagcagtgccagccggtgacgctggagcagtgccgggccctgccctggtggcggacgctgttccgctcggtgctgcggatgtttgccccgctgatgtag

SEQ ID NO: 2516 - DNA, 1614 bp, Unknown
  Artificiall/Consensus sequence
atgaacgtcttcttcctcggcgtcatcgtcagcatcgtagtctacctggtcgtgggcctgttggcgggacgtaaggtcaaggatatcgacgactattacgtcagcggccgcaacgccccgaccatcctcatcgccggaaccctgtttgcctccatgctgtcggtcaatggctttatgggggatcagggcttctgctacaccggaaatatcaccactctggtgctgctcaactccatgtgcgcctgcggctatgtgttcggtccgctgttcttcggccgctacctccgccggtctgagtgcggcaccatgcccgagtacttcggtgtccgctacaaggatccccgcatccgccgtgtcgcgggcatcattaccatcatctcgctgaccgcttacctgctggcctgcatcaccggcgtgggtatcctcatgcaggagctcaccgggctgagttacgagctatgcctgttcatcgcgtgggcctgttttaccgcgtttaccttctattccggctccaagggcgttatcatcaccgataccatgatgtttatggttttcatcgtggccgccattatcgccgggccctacatcttcaacgcccagggaggtctgggcagcctgctggagaacctgatgaataaccccgccgccgctgaaggcctgttggattatcatggcaacatccccggcaccggagcgtccgacgtgttcggcgcggtgatgtatgccgtcaccatgggcatcatctggttcatcactgtaggcgtctctccctggcaggcaggacgcaacctgatggccaaaaacgagcacgtcatcttccgcgccggtgcggtggccgccgtgtgcaccaccgtgtttctgctgtatgtaaacctcatgtccatctcggtcatcaatctggcgcccaatctggaagacccccagcgggtgcttatctgggcggcgttcaacgttatgcccaagctggtgggcaccctgctgctggccggcatcatggccgcggggctctcctccgcctccaccttcctgtcggtggtgggcttctcggtgacctcggacattttccccgtagcgttcaaggacgagaaacatcagctgcacaccagccgtgtcattatgctggcggtaggcattgtctccctcatcctggcctatctgggcctgggcggcgtgcgagtgatctcctggtttgcctccaccatcatcgccgcctcctggctggtgcccggtgtgggcagtattctgtctggcaagctgtccgccactggagcccggtggtccatgacggcgggcttcttgggcttcatcctctcgaagtgtctggtgggcttcggggcaggccccttccacagcatcttgatcaactttctggaccccttcttcatcgggctgtatctcagcctggccttcgcggtcattggctccaagctccgcccggtgacgccggaggagtccgcctaccgggacaagctgcttgtgctgccccagggggagcgggcggcccgtgagtaccagagcgaccggcgttacggctggctcctcatcgtcatgggggtccttacaaccctgtttttgctgctgacctgggctctgcccttcaacggcctgatctga

SEQ ID NO: 2517 - DNA, 1170 bp, Unknown
  Artificiall/Consensus sequence
atgagcgacagaaatctcgtagagcatgtggaggccttcgccatcaaacgggtcctggactatctcaacgatacggagaacgtggacgacgccattgagaaggctatggactgggtggatcggttcgacaagaagggggaggtcgccggtcagcgcgcagtcttccgcaagatcgtggacagcaagcagggcaactggtacgacctcatcaagaaggtttggaccgagatcgaccccggcgtccgcggcaagtttttcgagaacttcgttctcaacgccaccgccatcggcggccagcgtcaggacaagaccaaggagaagtacggctgcaacgtgccttgggccatcctgatggaccccacctccgcctgcaacctccactgcaccggctgctgggcggcggagtacggcaacaagctgaacatggactacaacaccctggactctatcatccggcagggcaccgccatgggcaccttcatgtacatctattccggcggtgaaccgctggtccgcaaggatgacatcatccgcctctgcgaggcccacccggactgcatgttcctggccttcaccaacgccacgctcatcgacgagtcctttgccgacgacatgctgcgggtaaagaactttatcccggccatcagcgtggagggcttcgaggaggaaaccgacttccgccggggcaagggcacctatcaggccgtgacacgggccatggagatcctcaaaagcaggcgtctggccttcggcgcgtcctgctgctacaccagcaagaacgtggacgtcatcggcagcgaggagtatttcgacgacctcatcgccaagggcgcgctgttcgcctggttcttcacctacatgccggtgggcgccggggcccccaccgatctgatggccaccgccgagcagcgggagttcatgtaccaccagattcgcaggttccgggacaccaagccgctgttcaccatggacttctggaacgacggggaatacgtcaagggctgtatcgccggaggccggtattatctgcacatcaacgccaacggcgacatcgagccctgcgcctttatccactactccgactccaacatccacgacaccacgctgctggaagcctaccagcggcctatgttcatgcagtaccacgaccaccagcccttcaatggcaac

SEQ ID NO: 2518 - DNA, 1530 bp, Unknown
  Artificiall/Consensus sequence
ttgagcaaagaggatgaggacaaatacaaaacagagtccgaaagtatccaaaatcaaaaatctctgctggtgagctacgctgtggagcgtggctgggatatctaccacatctactgcgacgaggattattccggggccgacagcctgcggcccgatttcaaccggatgatcggggcggccagggagaaaaggttccaaattctcctctgcaagagccaatcccggttcacccgggatatggagctggtggaaaagtacatccatggcctgttccccatctggggcgtccgctttattgcggtggcggacaacgttgacacggaggtgaagggcaccaaaaaggcccggcagatcaacggcctggtgaacgagtggtatctggaggacctgtcggaaaacatccgcatggtctttgacctgaagcggcggcaggggcagtatatcggagcgttccccatctacggctatcagaaggacccgaaagaccacaatcatctgattgtggaagcgcaggccgctcaagtggtgcgtcagatcttccagtggtccctggagggccgcgggaaacaggagatcgcccggatgctcaacgaccggggcatcccgaacccggcccggtataagctggagcggggggggaccgccggtcccccgggctccaaccagtatggcctctggaacaagaccaccatctggaggatgctccacaacgagatgtacacaggggtgatgctccagggccgacggaaaaaggcgagctacaaatccaagacgatgctcccggttcccgaagatcagtggtatcgggtagaggggacccatgaggccatcattgaccgggagaccttccgcgcggtacagagaagcctgaagctgcgctccaaggccgacggtaccggagaagcccacctgctgtccgggctggtgaagtgcatggactgcggcagcaccatgagcaagaccaccaactgtcagcaggggcggcccagggtgtcctacctccgctgcaagctgtatgcagacagtggaagggagaagcgctgcacccggcactccatccgtctggatcaactgatcgagcaggtttccgaacgcatccgccactatgttcaaagctgctgtccgctggaggaactgaatgtgcctccgccgcgggacacccgcagagaggctctggagcaggagcagaaagcgctgaaagctcaactggaaaagcggagccaggcgttaaaaaatctgtacctggataaaatctccggcgtactcagcgaggggcagttcgtggagctgaaccgggaccttcagatggaaaaagggcgcctggagcgtcggctggctcaaaacggtgaggagctgaacaaacggacacacccggtggaccaggccagcattatggaccggatgcgggagctgctgcagttggagaccgtgcctcgggagctggtggtcgctctggtggaaaagatcgagattggcgagcgggacccggccaccggacgccaggagattcggattacctggaaattttaa

SEQ ID NO: 2519 - DNA, 1167 bp, Unknown
  Artificiall/Consensus sequence
atgaaatttgagttcgacaccgcccactcccgtgtgggcatggagtccgccaagtgggatgccatcggccccaaccccgcccagggtgtggtccccctatccgtggccgatatggaactgctctccccgcctgagatcatcgaggagctgaagagcaccgccgagtttggcatgtggggctacacctggtggggccagcggtacgccgacgccgtcaagcactggctgtccacccgccacggctgggacatccagaaggactggatcatccagaccaacggtgtggtccagacgctgtacgcctccgtccgagccttcacccagcccggggacaatgtgctgctcctgacccctgtttactaccccttctaccgggcggtgaacctgaacggccgcaaagtggtggagagccccatccgtctggtggaaggccgttatgaggtggactttgacgactttgaggaaaaagccaagcagtgcaagatgttcctgctgtgctccccccataacccgatgggccgggtgtggagcgaagaggagctgtgccgtatgggcgatatctgcctgaagcacaacgtgctggtggtcagcgacgagattcacttcgatatcatcatgcccggtcacaagcacgtcagctatcccacgctgggagagaagtacgccaacaactgcgtcatgtgctgtgccgccagcaagaccttctctctggcgggcctttgcgtggccaacgccatcatccccaaccccgagctgcgcgataagctgaacaacgaggtaaacatctccggctgctatacctacagcatcttcggcctccgggctctggaggccggttatatgaagtgcgccgagtgggtggatcagctcaatgagcacatctggggcaactacctctattttaaggagttcatggcgaagcatttccctgaggtgtgggtagccgatctggagggcacctatttgtgctggttcgactgtcgctgctttggcatggacggcgagaccctggccaagtttcttcaggagaaggcccaactgttcctggacgatggctacatcttcggcacagctggggacggctttgagcggatcaatctggcctgcacccggaaagtgctggaggaggccctgctccgcttcaaggccgctatggatcagcggtaa

SEQ ID NO: 2520 - DNA, 1632 bp, Unknown
  Artificiall/Consensus sequence
atgcctgagattatactcacccacgtgaccaagcgctgggacaaattctacgccgtggacgacctgaatctggtcatcgacgacaacgccttcgtcacgctgctgggcccctcgggctgcggcaagaccaccacgctgcgcatgatcgccgggctggagacccccaccagcggccgcatcaccattggcgacaaggtggtgtttgactccgacgccggcatcaatatcccacccaataagcggaaggtgggcttcctgttccagaactacgccctgtggcccaacatgacggtctaccagaacatcgccttcggtctggccaacatcaaggaggagctgcccaagtttgacctggaggcccgccggaccgccgccctcatccgcatcctgcaaaggccggacgacgtggttcggaccatccgggagtgtgtggacaaaaagggcaggctggacgtgaacaaggcccatatcaagctcatcgaccgctatgagatctccctccacaccgccaagaccctgatgggctacaggctccacgagtctatggagccggtcaccgtggccaaggccagactggagcagttggaaaaggcgctggagagcgcccgggcggcgtgcgccgcccagggctgcaccttccgggaggatttcgcctacctcaaggacggcgtgcctgtgaccggcgtgcgcaagctctccccggaggagatcgacctctcggtccgccgggtggcccgcattgtcaaaatcggcatgttcatggaccgttatccctccgagctctccggcggacagcagcagcgggtggccatcgcccgcaccctggcccccgagcccgcggtactctttatggacgagccgctgtccaatctggacgccaagctgcggctggagatgcgctcggagctccagcggctgcacatcgacaccggctctacctttatctacgtcacccatgaccagatggaggccatgaccctggccaccaagatctgtctcatcgacaacggcgtgctccagcagtacgacgcccccctggacgtctataataagcccaacaacctctttgtggccgacttcgtgggcaatccggccatcaacttcatggaggccaaaggccatcaggcccccgacggcacggtggagctggaggcctttgcgggcacccggctcgctttcacgccccgcacgcccctggacctgccggactggtttgcccgggccgacgcccgggacgcggagaaaaaggcggcagagcaggccaaacagagccaaaagggccatgtggagaagggaaacaaggacacccccttccgctgccacatcgccaaggtcaacgagacggaggatttcggggacgaggccgtcctctccgacgaggacttcgtgctgggtgtccggcctgagttcctgtccatctcggaacacggcgcgctggaggccgaggtctacagcgccatgcccaccggcatggagactaccgtcaagctgcgtattggggagtatctgctcaccggcgtcatcttcggcggcgtgctctatcagatcggccagaaggtgcgggtggactttgagggggatcatatggtattatttagccgtaagaacggccgaatcatcacccaggggtcc

SEQ ID NO: 2521 - DNA, 1197 bp, Unknown
  Artificiall/Consensus sequence
atgcgagaagttgtcattgtcagcgcctgccgtactcccatcggcaaattcaacggggcctttgcctctctgtccgcccgtgacctggccatcgccgccggaaaggaggccatccgccgggccgggctggccccatcccaggtggacgagatcgccatgggtcagctctacaccgccatgcagggctctctgcccgcccggcaggtgagtatgcgcatcgggctgcccgcccgcagcaacgccgtcagcgtaaaccagaactgcgcctccgggatgcgggccctggagatcgtctgtaatgatgtggcgctgggtaagaccgacattggtctggctgtgggtgtggagagcatgaccaacgccccctatctgctccccaaggcccggaatggctaccggatgggtcacggccagatcaccgactccatgctccatgacggcctggtggatgagttgtccggagggcatatgggcgtcacggcggaaaatgtagccaagcgctacggcattacccggcaggagtgcgatgagctggccgtcttgagtcatcagcgtgcctgcgccgccattgatgccggaacatttaaggacgagattgtcccggtggaagtccgcagccgaaaaggcactgtggtggtggataccgacgagcatcccattcggggtgctgatctggcgtccatggcccagcttcccccggcctttcagcgggacggcgtgggcaccgcggccaacgcctccgggatcaacgacgcagcggcggcggcggtggtcatgtcaaaagagaaggccgacgcgctgggcatcgctcccctggcaaagatgctccatatctgcggtgagggagtggagcccgaggtcatgggcctgggtcccgccgtggccattcccaagtgtctgaaagcggtcggcctggcatttgaggatgtggactactgggaggtcaacgaagcctttgccgcccagttcatcggagtggaacggatgctccaggaagagcacggcatgcagatggaccgggcgcggaccaatatcaacggctctggcatctccctggggcatccggtgggctgtaccgccctgcggatcgtggtgtctctgatctatgagatgctccactcagggtaccgggtgggaggcgccgcactgtgcgtgggcggcggtccggccatggcctccctgtgggagcgcatctga

SEQ ID NO: 2522 - DNA, 981 bp, Unknown
  Artificiall/Consensus sequence
atgggttacctgctcaacgaagaccagcaagccatcgtcagctccgtcaaggcgtttatggaaaaggaagtggcgccggtctgcgccgaatgcgaccgctcgggcgagctgcccatggccgcctatgacaaggcgctggagatggggctgcactgcatggagattccggaagagtttggcggcggcggcatcgactatatgactgtggcggctgcctgtgaagagatgggcaaggtagacgcggggttcgccaccaccatgggggccaccggcctggccatcaagccggtccttctggccggcactgccacccagaagcagatgtactccgacatcctcacacagaagaagtttgccgccttctgcctcaccgagcccatggccggctctgacgcaggcgcctgcaccaccaccgccatccgcgatggagacgagtacatcatcaacggctccaagtgctttatcaccaacggcgggatcgccgatgtgtacgtggtttttgccaacgtggaccgctctaaggggctgaagggcctgaccgcttttattgtcgagcgcagccgccccggcgtgagcaccggcaaggaggaggataagttcggcatccgcctgtccaacacctgcgatgtgatctttgaggatgtccgcgtgcccgtggccaatcggctgggcgaagagggcgagggctttaagatcgccatgcgcaccctggatctgtcccggcccttcatcggcgccatcgctgtgggcatctcccaacgggccctggacgaggctgtgagctactccaagacccgggtgacctttggaaaacccatcgccaagcagcaggcgctccagttcatgatggccgacatggatatgcagaccgaggccgcccggcagaccgtgatctactgcatcaaccgtatcatgatacacctgccctactcccgtgaggccgccatctgcaagtgcttcgccggcgacaccgctgtgaag

SEQ ID NO: 2523 - DNA, 1317 bp, Unknown
  Artificiall/Consensus sequence
atgaccggcggagccctgttttccatgcattttggcgcatccagtatggtgtggcccatgaactggggcaaagagagcggaagctcctggccgctggccttcatcggagccttcatcactgccatcctgctggtgctggtcgcctatgtcgcgctggcaaaatccaaccaatcctacagtcaaatgactggccggctcgttgggaaccgctttggagcgttctttacctgcctgaccatcgtggtgctggggcccctctacgccatcccccgtatgagcgcggcttcctgggattccatcgtccaggcatttgggctcaaccccacttccaagctgcccctcatcatcttcaccattctattctatattgtgacctacttcttcctggccaaccccggaaaggccatggaccgcatctccgccatcctgttccccattttgctgatcattgtggtggccgtggtcggaaaggggctgctcaaccccatcgccgcgccggtggcgaagtcctatgagggcaacgccttcgcttacggcttcaccaacggctacgccaccgcggagatcctgtgtgccctcatcttcggcgtggtgatcctcaaaaccctggagaacaagggcgtcgcccatgatcgcatgagcaagaacatggtccgcgtgggcattgtggggctggccatgctaagctgcacccacctagcccatatgatcatcggggccaacaccggcggtacgctggatctgagctacacggctctttacaccgccgtggctgccatcttgtatggcaaggtgggcgggatcctcttctccatggcgctcttcctggccgccctgaccaccgccatcggcatgacctccggctgcgctgagtttttcgtggaagtgagtcatgaaagactcaattacaagcagtggtcactgattatggtagtcctgagcatcatcttcggcagcctgggcctgaccaacattctctctctgctgggccccatcctggacggcatctatccccccgctatcgtgctggtgctctactacgcgctgtgccccaacgccatgtccccccggcagacgctggccgcacgctgggcgatgtatgcctcagtgatattcggcgctctggatatgatatggaaatactttgtaaaacttgacgccaatcccggcgggatttgcgatctctatctgaagctcccctttgccgacgtgtccctggcttgggtgccctttaccatcctggctttcatcattggttggtttgcctaccgggaaaaacagacggatccccctctgaaaagcgcagcggacgcataa

SEQ ID NO: 2524 - DNA, 1410 bp, Unknown
  Artificiall/Consensus sequence
atgatggataccttcggcattggtcgttccatggaacctgcccactccctgccccagcaggcatggagaatcgacaacaccaccgagctgcgcccggatgaattgctgatcgacgtcaagatcgtcagcatcaacctggtcagcttcaacgagatttgggatgagaccggcgacaacgacaccctgctgtgccagcgggtcatggagatcattcaggagcggggcaagcttcataatccagttaccaacacgggtgggatgctctacggcaaggtggcccaaatgggctcagaataccccaatttgtatggcttggctcccggtgacgagattatttccctggcgtccctatcgatcacccctctgaagctcgaccggattttatgtgtagactatgcgtgcgcccagttgacggtggaggggcaagccatcctgtacgccagttctccggtggtgaagcgccccccggatatccctctgcaggtggtcatctccgccatggatgaggccggcgtgtccgcgtgcacccacaggatcgtggagccggggcagtccgttctggtcctgggcgccggtgggcggagcggcttgctctgcggctatgctgcccgcgataagatgaaatccagcggccggctggtgggcattgtccgaaacgaaaatcaccggcagctgctggagcggtacggtgtatacgacgaggtgctggcgctggacgccacagacatcgaaggcttctgctccggccgggaaagtgcggtcgcccagcagtttgacgtggtcatcaactgcatcaattcagtcaacacggagattgccgctctggtggcggtcaagccccggggcattctttactttgccacccttgggtgcgactataagttcaccgggctgacggcagaggggatcggcaagcaggtacacatcatcccctatgccggatttatggaggggcatgccgagtataccctgggtctgctgcgccgcttcccacagatgcaaaaggcgatccagcagcaatttggcgaggcacggcggcaccatgtgctcgtggagcatgaggagcacagcgaaacaagggacgatccccacgttgcaaacgccaacggctatatcttccgcagcagccagtccaaagccactctgcggcaagcgctgaaggtgtcccgctatacctccaatgtgatgatctacggtgaatccggcgtcggcaaggagattatcgcccgcatcatccaccaaaacagcgagcgaaaaacctttcccatgattaaaatcaactgcgccgccatcccggagaatcttctggaatccgagctgttcggctatgaaaagggctcctttaccggcgcaaatgcaaaaggcaaaattggattatgggaggcagcccagagtgggacgctgtttttg

SEQ ID NO: 2525 - DNA, 666 bp, Unknown
  Artificiall/Consensus sequence
ctgaccgaggagaacgcccccgcacgggcagcctatggcgccgctctgatggagctgctggatcacaatattctgcccgacgggaccgactattccaacggctatattggcagtattgaggatagagagagaatggcgcaaaaccagtttgccgtctgggatgtggacggagatggaagagaagaactgatcctcctctacaccaccactatagtggccggggagcgaggcttcgtgttcgattgggacgaggcgtcgggagagctgcggacgcagttggaggaatttcccctgctcaccttttatgaaaacggcgccgttatggcgggctggtcccacaaccagggcaagggcggagatttctggccctatttcctctaccagtatctgcccgagaccgacggctaccagcaggtgggcgcggtggatgcctgggacagggccctggggatcgagggctatcccgaccaggtggaccggagcggaacgggctttgtctactatatctacggggatctggcggcggaatgggacaaggtcgagccggtggacgccgccgagtaccacgcctggctggacccctatttgggagagggcgaagagctggcccttccctattgcccgctgacggcggagaacatccggatgatccagacggcgggctga

SEQ ID NO: 2526 - DNA, 1230 bp, Unknown
  Artificiall/Consensus sequence
atgatcaccttttttgcctgtctggtgctgttgctggttggttttttcacctatggcaagctggtggagaaggtattccggattgatgaccggcctacccctgccgtagcgcacccggacggagtggacttcgtccccatgaagacctggcgcatttttctgattcagcttctaaacatcgccggactggggcccatctatggtgcgctggccggtgcctgctgggggcccgtggtctacctgtggattgtgttcggaaccatcctgggtggcggcgtccatgactttctgtcgggtatgatgagtgaacgccacgacggcgcgtccatctctgagattgtgggcatgtacctgggcaaagtgatgaagttcgtcatgcgaatcttttcggtggtcctgctggtgatggtgggcgtcaacttttcggtgggtcccgccaggctgattagccagctcattagcgagagctttggtgcgtctctgcccccgatggtgctgtccactaccttctggctggttttggtgctgctatactacctgctggcgaccttcctgccggtggataagatcattggcaaggtgtatccgttttttggtatctgcctcatcatcatggcagtgggcattgcaggcatgctgatcctcaagccggagtacagcatgcccgagctgtgggagtccatgggcatcgtccaccccgaaggcctgcccaaatgggccatgatgtttgtcaccgtggcctgcggcgccatctccggcttccatgccacccagtctcccatgatggcccgctgtatgaccagcgagaaggagggccgcaccgtattctacggggccatggtaagcgagggcgtcatcgctctgatttgggccgcggccggtgtgaccttctataatggcgtgggcgctttggatgcggccatcaacgccatgggtcagggtggggtggtttaccagatttccaccaccctgatgggttccgtgggcggtgtgctggccatgattggtgtcatcgcctgtcccatcacctccggcgacactgccttccgttccgcccggttgaccatctcggattggtttcacatcgaccagtccaacgtggtcaagcgcgccgccctatccgtccccctgctggctgtgggcgcattcatcgccaccagcctggatttcaatgtcctctggcggtatttctcctggtccaaccagacgctggccatgctggtgctgtgg

SEQ ID NO: 2527 - DNA, 729 bp, Unknown
  Artificiall/Consensus sequence
atgcaagacacgcgcaaagagcagctgctgaagttctgtcaaagccttggcatcgaaatgcacaagctggaacttctaaacagcgctctgacgcatacatcatacgctcacgaatctaaagaattaccgcgtccggaacataacgaacgcgtagaatttttaggcgactccgtgctcagcgttatcgtcagtacatatatgtactgcactttccccaaccttaacgaaggagaacttaccaagctcagggcccatatcgtctgcgaagcatctctggctgaatatgcccgtaaaataaatcttggtgattacctgcttttaggaaagggagaaggtttgtcaggaggacgcgaacgcgcttctatcctggccgacgcttttgaatctgtacttggggcttattatttagaccagggtatggaagcagcccgtgtatttttactggggttaatgaaagccgagctggattttatctgtacgcacggcatttgcagtgattttaaaacaaggctgcaggaagttgcgcagcaggatggcgatgttgatatcgtctacgagctgatcggttccaaaggtcctgaacacaacaaacattttgccaccattgtttccgttaacggtaagcatatcggttcaggcgaaggcaggacgaaaaaggaagcggaacagcaggctgctaaaagcgctcttgaaaaaatgggcgcgcctttgacaggctttcctaaataa

SEQ ID NO: 2528 - DNA, 471 bp, Unknown
  Artificiall/Consensus sequence
accgacaggaaaggatgctgcaaaatgaaaatcaaagatacactgatcgtattatttattgtcggcgccatgtctcttgtcgccaacgctattggcaccaaatatactatcgtggaagcaattcccggtctgctatttttaatatttttggcaattgccggtgttgttctggcaaaatatttgccgggacgtatccctgctgttgcttatatcgtaactttgggctgtatcctgacttatccgactatgcccggcagtgacgtgatcaatgaagctgttaaaaaagtaggctttttacagctttgtactccgattctcgcttatgccggtatcgctatcggcaaagaccttgatgcttttgccaagagcggctggcggatcgttgtagttgcctgtgtagtttttacaggcacttatatcggcagcgcgattattgcgcagactatcttgaaggcactgggacagatttaa

SEQ ID NO: 2529 - DNA, 801 bp, Unknown
  Artificiall/Consensus sequence
caaaatcgcggcaggcgaagcatgagcagtgagtttgaaatcacgattctggccagcggcagtaaaggcaatgccgcggtgatacgtgccggagagcaggcttttctggtagatgtcggcatcagctgccgccagctgacggaacgtctgcatcaggcaggcatgaagcctgaagatttgacgggcgtactgttgacacatgagcataacgaccatgtaaagggactgcctgttttttgccgtaaataccgtctgccggtgtttgccaatgaaaggacctggcagtatatgccgaaaaaaagtgaaatggaacgcagctgttgccgcttactgcccaaaaaactgagcagcggcagtttggaaataatcccttttgccgtcccgcatgacgcagcctctacagtaggctatgtttttaaaagcggcggcagtaaatgtacatatctcaccgacgtaggctttgtgacagacgaggtgcgtcagaatatagctgatgctgacgtagtggtgctggaagccaaccacgatgaagatatgctgaaaaatggcagttatccgcagatactcaagcagaggattctgggaacacgcgggcatttatccaatgtttcggcagcctggctgctggcgcatatggagcgccttccggaagaggtttttctggcgcatctgagccaggaaaacaatttgccttccctggccctgcaaacggtgcggggtattctggacgctaacgaagttggcgcggatacaaaaatttatatcacatcgcaggaaaacatagtaaaaaattatgattga

SEQ ID NO: 2530 - DNA, 525 bp, Unknown
  Artificiall/Consensus sequence
gtgcaagcgatgctgaaccggtcgtccaagaacttaacgactgagcaggaagcgtatgattatgctttagatattctgagctatcgtgattacagccgtaaggatatggaactgaagctgaaacgtaaaggtgcagatgctgtcatcatcaagagtactatccaaaaactgctggaatatggtttcttagatgaaaaacgttatggacagagggtttttgaagcctggctttctaaaaaatactatggcagatgtcacctgcggctggagctgcagaaaaaaaatgtggccgaacgttatataaacgatattttagcgcagttttctgaagctgaggaacaggaacgggcggagaaggctctgcagtcttgtttaaaacgtaatcctaaaaaatatgatcctgctacgcaggaaggccgggccgctattggcaggtacctgtatgcgcgtggctttgcaagtaaatatattcaaaaaagcattaataatatacatggttctgtgatattaatggatgactgctaa

SEQ ID NO: 2531 - DNA, 429 bp, Unknown
  Artificiall/Consensus sequence
ggtcggcttttttgttatataattatgataaaattaatgccgcctgacgaaagcgaggtatctgccatggaaaaacaaaccttgatcgctcattgccttacttatcctaatgctgtcgaagattatccctttgccgataacgatctcactattatgcgccatccatccggtggtaaatggtttgcctgtattatgcatcttcaaggcaagctctgcataaatctgaaatgtgatcctgtcagatccgaatttctgcgccgtacttacaaaggcgtttacccggcctggcatatgaacaaagaacattggaacaccgtcgaagtaaacagtgtacccaaaggcgaattatttgccatgatcgcccacagctttgaactgaccgcgcccaaaataccaaaagcgaagcccatgagaaaaacagagaaataa

SEQ ID NO: 2532 - DNA, 690 bp, Unknown
  Artificiall/Consensus sequence
gaagcaaaaatcattatagaagatgaggaggagtcggggatgacgattgcgaagcatcttgaacatactttattaaaacctgaggcaactgtcgaggatattatgcagctttgcagcgaagcccggaaatacgggctctttggcgtttgtgtgaatccgtgttatgtggggctggccagacatctgctgagcgatacgaacgtcaaggttgtgacagtagtagggttcccgctgggagctacattttctgaggtcaaggctctggagacaaaaatggcggtcgaagcgcacgctgatgaaatagatatggtcatgaacgtatcggcatttaagaccggtgattatgctgctgtagtcagtgatatccgcagcgtagtcgaggcggccagtccgtttccggtcaaggtgatcattgaagcctgcctgctgacagacgctgaaaagtgtacggcctgtcgtttagtagccgaaggcggtgcggcgtttgtcaagaccagtacgggttttaacaagggcggcgctactgtcgatgacgtaaagctgctggcagccgaagcagaaaagtatggtctcaaagtcaaagccgccggaggtatccgtgacgcggaagctgcgcaggctatgctggctgcaggagctgaacgtattggaaccagtgccgggcacaaaatcgcggcaggcgaagcatga

SEQ ID NO: 2533 - DNA, 573 bp, Unknown
  Artificiall/Consensus sequence
ggggagagctgcgaaatgaaaagcaagaatatcaatcagcttgtattggccggggtactgtgtggtatcggtatcgttgtgccgatgttgatgcctaaaatagtgatcgggccgatgtcgtttacgctggctagccatgtggctatttttattgcgatgctcatatcgccgaagctggccgcagtagtttgcttgggaacgacgctgggattttttatgacgacgcctgtaattattgctctgagggctgccagccatatctgttttgccctgcttggggctgtgctgatcagaaaaataccggaaattattgaaaagccattgccaagcactgtgtttaatggtgggctggcctttgtacatgctctggctgaggttgccgtcgtttcacctttctttctggccggcagcattttcaaaccggaacagcttgccgacggttatgttatgagcgtacttgttctggtaggggttggtacatttttacattcgctgatcgattatactgtttcgatcatgctgtggaagcctgtacgtgctgcattgccttcgctggccgagctgcgtgaataa

SEQ ID NO: 2534 - DNA, 1236 bp, Unknown
  Artificiall/Consensus sequence
atgactgattttaaaaaaatagaagaggaagcattattagaagtattacatgctgctgaaagctatgaagaagcagctttgtataatacagaaaaggttatgcaagcttttagaaagcatatggtatcagatttttatttaaaaccaactactggatatgcctattccgatgttggcagagaaaaattagatgaaatatatgctgatatttttaaaacggaagcggcattggtacgatctcagtttgtttcagggactcatgcattagccgttgcgttactcggagttttgaaagcaggcgatgaagtaatcgctgctacaggagctccatatgacacaatgcagactatcataggcgtacctgtaaaaacccctggctctcttactgacttaggcgtagtctataaagaaatccccatgattggttcacaaattgatcttgaaaaaatcacagctgcaattactgctaaaacaaaaatgatccatattcaacgttcatgcggttacagtagtgtgcgtaaaacgttaagaattgaagaaataggaacgatctgtaaagcagcaaaagcaataaagcctgatattatttgttttgttgacaactgttatggtgaatttattgaaaaacaagaaccaacagaagttggagctgatctaatggccggttctcttatcaaaaaccttggaggcggtcttgcacctactggcggttatattgttggccgaaaggatttagtagaacttgcgtcatatagattaaccgctccaggattaggcggagaaatgggggctacacttggagatacggccagagaattataccagggcttattcttagctccgcatatagttttgcaagctgttaaaacagcaatttttgcttctgcagtattttcacgcctgggttatcaggttactccttctgcaaatgatagacgcagtgatataattcagactattcgtttggaaactaaagagcgtttatgtaatttttgtatagccatacaaaaaaattcaccagttgatgcacatgttgttccagttcctgcaataattcctggctatcaagatgaaataattatggcagcggggacttttgtacaaggcgcatcaatagaattaagtgctgatggcccttgccgtgaaccttataatgtatattttcaaggaggacttacttttgagcacgggcgtattgcaattatgtcagctgcaaaaatggtaggggagaaataa

SEQ ID NO: 2535 - DNA, 810 bp, Unknown
  Artificiall/Consensus sequence
ttgagaatcaaaagcgcgttcttgtataaggacgcgctttttgataaatacttgcaggaggatacgatgcagataattatttccccagcaaaaaaaatgcgtattgataatgatgaccttgtttctgcggcagaaccgcgctttttaaaagatacagaaattttactggcagagctgagaaagatgcagtatgatgatctaaaaaagttgtggcaatgtaacgatgagattgcggcattaaactataagcgtttacagactatgcgtctgcgtgctaatcttaccccggcagtattggcttatgacggtatccagtatcaatatatggcaccgcgtgtttttgaaaatgcacagcttgattatgtggcagaacatttaaatattttatcagggttttatggtattttaaaagcaatggacggtgttgttccttatcgtttggagatgcaggcaaagctgccggctgccgggtgtaaaaatctgtatgacttttggggaagcaggctttattttgagctgacgcaaaacgataaaagcattcttaacctggcatcaaaagaatacagtaaagttatagaaaaatatttgacgccagaagtggaatatgtcagctgtatttttggcatttggcaggacggtaaagtaaaggttaaagctactgaagcgaagatggcccgtggtgaaatggtgcgctggtgtgccgagcataatattttacacattgaagacacaaaaaaatttgaccggttaggatataaatatcagaaggagcaatccaccgcaaaagaatttgtttttctgaaaaactga

SEQ ID NO: 2536 - DNA, 735 bp, Unknown
  Artificiall/Consensus sequence
gcagccatgataatttttcctgctatagatatccgcggcggccgctgcgtcagattgacggaaggtcgttttgaccaggaaactgtttttgctgatgatccttcggaaatggctgcccgctggtcggcagccggagccgaatatttacatgtcgtcgatttagacggtgctttggccggtgcgggacgtaatctgccggcaatccaaaaaatcctggagcacgcttctatgccagtgcaggtaggaggcggaatcagaagtctggcagctgtagcagaattgctggaattgggggtcagccgtgtgattcttggatcagcagcagtgcgggaaccgcagctggttgctgaagcctgtcgggaatttcctggtcaggttgttgtaggtatcgatgctaaagacgggaaagccgctatcgaaggctggggtgtcagcggtggtattgatgctgtagagttggctctaaaaatggctgctatcggggtcgagcatattatttttactgatatcagccgtgacggtaagctgagtggggtgaatgtagaagccactgccgctttggcaaaagcctgcggtgttaaagtcattgccagcggcggtgtggcatcgttggaagatatacgccggctgcagcagcggtcctcctctgggatcgagggctgcatcatagggaaggccatttataccggagctattgacctgcgggaggctctgcgggtcgcaaaggaggtctga

SEQ ID NO: 2537 - DNA, 474 bp, Unknown
  Artificiall/Consensus sequence
atgggaaaaacgccagcaggaataatgataaggactttgacagcggcagatttgactgctgtcagcagcatagatgaaaagtctttttttgatgtttggagcccaagtatgtggctggatgagttgaataacagcttaacaacatatcttgttttagaagatgctgggcgtattcttggttatgccgggttttggctggtggcaggggaagcgcagataaccagagtcgcggttgctgctgaagaacgtgaacacggcttgggaacaagcttgacagcagccctgatcaataaggcatgggaacttggcgctgtggcggtgactttggaagtgcgtgagagcaatattgcagcgcaaaaggtttatttgacctgcggttttgccagcgaggggataagaccaaattattatgaagataatcatgaaaatgcaataatcatgtggttatataaggagggtaagcctgatgtctaa

SEQ ID NO: 2538 - DNA, 819 bp, Unknown
  Artificiall/Consensus sequence
atgaagatgtcgcggaaatttataactgctggtgtggcaggagtcatggctttggggatagctgtttcagcatgggctgcagaacctcagattactgatcaaaaaatacgttctggcggagtaacagttaatatccctgttgtgaaaggcgccgtaggcggtgcagaagttgatgacaaagtgaatatggcaattgattttaatattgtgaaaaagttgtatgcttatttgcccggaggaagtaatggactgagtttacaggaaaattactatcctgagtttgacggttacggtggtgcgaaggcgagccgtgagtttgtgactgatatagcaggctttatcaatcgtcaactgcaaaatcaggcgcaggcagctcataaagccggttctcatgtcaaacagtatacgtttgacggcagatatcaagtgcgttttaacagtgaagagttactttctttagaacaaacttatatggattatttgggtggtgcccatccgaatacatatttggatacgatcaacgtaaatttaaaaaacggtaaattactgagtttaggcgatatgtttaaagctggcagcaattatctgccgcgtttgaatgccattgttgcaaaacaggtggcagacgaacagcagttaaagggattttttgataaaaaagtagaagtgaacggaacagaaaatttttatattacggataatgctgatcttgttatagtatatccgccttatgctgttgctccgtatgctgccggaacgatcgagtttatcattcctgttagccaggttgcagatatttttaattttaaattagaataa

SEQ ID NO: 2539 - DNA, 420 bp, Unknown
  Artificiall/Consensus sequence
attaagatgagaaatcttgcagatgcaatagaaaatttcatcatcagacagcttttagaggacagagaggacgctgttttagtacagcgtaatgaacttgccgataaactgtcgtgcgcaccgtcgcagatcagttatgtgctgagcacgcgctttactcctgaacgggggtttatggtcgaatccagacgcggaagcggcggctttgtccgtattgtaagggtgatgcctcatgaattgcaggaagagaactgtgagccgacagtgcatgatttgattgagcactgggctgctaaccgtttgatcagcaggcgcgaaaaatcactgttgcagtatatgatggaaattctggatgctgatgaagctaaaaaaagagctgttttgaagacggctattactaaaatgacagaacgtgagtga

SEQ ID NO: 2540 - DNA, 714 bp, Unknown
  Artificiall/Consensus sequence
gttgaaaggaaaagtttgaccatgcaagcattacgagaacacctgctgagcctgcaggacaccaaatatcagaaatttcacagtgccctttgtcccggtatcgataacatcatcggcatccgtatccctgtattgagaaaactggcaaatgaaatcctccgggatggagattaccctacttatctgcagaaagccttatacgaaccttttgtctacagtgaagaagcaaccttatgcggtatgattttaggtttactgaaaattgattttactgagctgctggaaaatctcaatatttttgttccccgcatcgacaattgggctgtttgtgatgttacctgcggcggtttgaaaggtttcaaaaaaaatcaggctcagggccgcgaatttctgcagcaatatcttgcttctcccagagaatatgaactgcggtttgctgttgtaatgctgatgaattattacaatgatgacacatatatcgacagtacactgaaagaactgaacaatgtacgacacgaaggttattacgtaaaaatggccgtagcctgggctttatcgctgtgcttcgtcaagcagcgagctaaaacaatggtactttttcaaaataatgaacttgatgactttacttacaacaaagcccttcagaaatgtcgtgaatccttccgtgtcagcgatgcagataaagccctgctgcaaaatatgaagcgtaaataa

SEQ ID NO: 2541 - DNA, 441 bp, Unknown
  Artificiall/Consensus sequence
atgcataaagagctgcaacggatacgccacggctactacgacctttggttcggcacaaacgccgtctatgaacgctgggccaaatcacacggactcaataacaatttactactgaccctgtatttgctgaaggaatttccaaatgactgtacccagcatctgatctgcgaaaaactgatgctgcccaaacagacggtcaacagtattctgtccggattggaatacaaaggcttcgtcgaaaaaataatcagccctactgataaacgcgtcaagctgttggtttttaccagtcagggtgctgcttatgccgacgggcttttacaaaaaatggatgattttgaagaacgggcgctgcgtaatatgactgacgcccagcgcaacgcactgctggaaggcggctttgcctggatgaaggctttacgtgacgccatagatgattag

SEQ ID NO: 2542 - DNA, 591 bp, Unknown
  Artificiall/Consensus sequence
atgttttattcagtcttaaagattattttaagaattttattcaaaatatttttgcggctggaagtaaaaggtgcagaaaatattccagcgacaggtcctttggtaattgccagcaatcatttaagtttgctggatccgcctgtaatcggtgtagcatctacaagaaaagtgcactttatggcaaaacaggagttgtttgtacctgttttgggtgatatttataaacttttgggcgcatttcctgtaaaacgtggtggggccgatagaacagcaataaaacatggtattgacttgatgctggatggtggtgtgttagctattttccctgaagggactcgcagtaaaacaggggcgttaggtaaggctgagccaggtgctttgatgatggcaggaaaagctaaagcagtcattgttccaacatgcgtaaaaggtaccgatatcaaacggcaggggaaattatggccgcaagtaaacgtcaaatttggaaaacctatttttttccctcaggatgtaccgatcagcaaagaactgctgcatgaacttacagaagctttgatgctggaaataaaacgcttacaagaagcggagtga

SEQ ID NO: 2543 - DNA, 420 bp, Unknown
  Artificiall/Consensus sequence
ttttctggaggtcagctaatgagaattgatggtgccggcggttgttttgataaccgtatttacgaaataaacaataaaagcgcttggaatctgttattgcttacagtcaatgaaatgggtgtgacggttgattcccgtgatgatgaaaatggcattcttgaatgccataatgataaaaaggttatgcgtttttcggcacaggcgatggacgaagaaactactcaggtttttgctgatgttcatggtaagaggattcaggtttataactggaagccacaggataaagaagtcaatcttttttacgacttatttgaaaacaagctgcgtgaataccgggcctttatcctttgtcccagctgtaaggccaaaatcagttcgcttgtaaaattttgtccggaatgcggtgtaccggtaaaataa

SEQ ID NO: 2544 - DNA, 846 bp, Unknown
  Artificiall/Consensus sequence
atggctgaaataagacgactggaagaagctccgttttgtaggggcttctttttgtgttataatgcagatatctatttcagaaaagagcggagagaaaccatggattattttgtcttgacagttgcttcgttgatattatttgctgctacttttttcagtactgtaactggttttggctttgcgctgatcgcagctcctgtattaacgatggtcatggggccgaaagagacagttgtatttgttattatcgccggtgttattgtgcgggtgatcatgatgtggcgtacctggggagaatttgagtggccgacagttttgataacagctgccggcagtctgttggggattattcccggagcgtatctgctgaaagtggctgatgccaatcatttaaagattttattagggatagcgcttttgcttgtaacgcttttgatggaattaaattttgtgcctgaggtcaaaaataaaaagctgggacgtgtttctgctggttttttaagcggttttttcagtgcgactaccagtatcagcgggccgccgatcgctttatattttttgagtgagaatatggagaaaaatttgctgcgcgccaatatgatctggatctttgctatcggcagtttttgtactttaggcagtttttttgttgcgggtacatttcagggtggaaatttgattgctttgtcgctgtatgtgttgccggcagtacttttaggctggtggctgggagaaaaaatgtttttccgtatcaatcagcatttatttaagcgcattgcgctgcttgtagtattgataggcggggtaatgactttgggaagtggcatcaacggtgtgctccattga

SEQ ID NO: 2545 - DNA, 342 bp, Unknown
  Artificiall/Consensus sequence
tcaaacattgatgaaggacgtgaaatgatgaaacagtttatgcacgtgggagtacccactgataaaatcatggaagacgctgtttatgccgaagctatcaagacatatatcgtagctcctgaaactaatgaattcaatattgaatacctgcgttttgagaaagatacacctttgccgaaagaactgcagactatggtccatgttgcttataaggtagacgacctggatgaacaggtaaaagcaaatactgttgttgttgagccctggtttgccgatgaaaatacccgccttgcttttattatgaaggacggtattttaatggaattgatggaagtgaaataa

SEQ ID NO: 2546 - DNA, 786 bp, Unknown
  Artificiall/Consensus sequence
atgggtgaggggaaaattttggaaattttagatccaagtacgattgcttttttattgttagcaggatttatagccgcatttatcgattcaactgttggcggaggcggtttaatttctacgccggcattactggccctagggttgcctgtaaattttgctttgggaactaataagctggctgcttctatgggcggtttgatgagtgttttttctttttggcgtgcgggaaagatcaatcaaaaggttgccataagtctgatgccgctttcttttctcggatcggctttaggtgcttatgtagtttatcttctgccggaacagctgatgaaaaatgtgatcgttgtccttttagtcgcagttgctgtttacacctaccgtcgtaaagactggggcgatgtatcggcagttaaacaattgggattggcagctttgcttgggtctgtagtaatggcctttggtattggcttttatgatggtttttttggtccgggaacaggttcgttcctgatttttggatttttatttttgggttatgattttgtaacggcagccggtaatgctaaggccctgaattttgccagtggtatcggagcgctgttgtcttttactttaagtggttcagttttgtggacttatggtcttttgatgggctttgccatggtgataggtgcttattttggttcccgtatggctatcagacatggtgcttcttatgttaaaccgctttatttgatcgtaaccacgcttttaataggcaagcaggtttatgaattgttgtttaagtaa

SEQ ID NO: 2547 - DNA, 888 bp, Unknown
  Artificiall/Consensus sequence
atgtatattaggatattgttgtctgaaaaaatacttaggaaacaggtgaagagtttgttattgcagctgcagggattattaaaaacgataagcattttagatgttttggatattttagttgttgcttatttccttttccgtatatacttaatgttaaaaaacactcgggccgcaactttagtcaaaggtcttttggtcttagctgttattttatttatcagtaaatggctgaatctgcatgttattacctggcttttggaaaaaagtatgacagtagtcatggtcgcgctgcctgtagtttttcagccggaactgcgtcgtgcgcttgagcagattggtcgcgggcgtttatttcataagcataacgaacttgatgaaaaagaactggaagatatgctgaatgccgttactaatgctacggaaattatgagtcgtagaaaaataggcgcattgatggtttttgaacgggagacaggtttggaagagagaattgaaaccggagtgccgattgacggtttgatttcagatagtttgctgctcaatatttttgaaccggatacacccttacatgatggcgctgttgttatacgcggtaatcgtatcgtagcagcaagctgcctgcttcctttaacagaagcacgtaatctgagccaggagttgggaacgcgccatcgttctgctatcggtatttccgaacagtcagatgctctggttttagtcgtcagcgaagagaccggcacgatttctctggcccgtaacggtgaattgcatcgctatctgaccggcgaagatattaaaagcttattaagagctgctgtagtacagccttctctgaattggaaacaggttatcaatgataaaatcaaagagattcggggtggcaaatga

SEQ ID NO: 2548 - DNA, 321 bp, Unknown
  Artificiall/Consensus sequence
atgttagacatggtagttattatttgttttatgggaaaggatgacaacagtatgcgtatcgtattaactatcgttggcaaagacaaggtcggcattattgctaaagtaagtaatattctcgctgagcatggcgtaaatatcctcaatatcaatcaaaatattatggagggtttcttcaatatggttttgattgctgatatgatgggtgctgctgtaaaattacaggatcttaaggatatctttactgctttaggcagagatatcggtgttgagatcagagtacaaagcgaagaaatatttacggcgatgcaccgtatctag

SEQ ID NO: 2549 - DNA, 651 bp, Unknown
  Artificiall/Consensus sequence
atggagtttaatttttcatatactgttttttacgaagacgaatatctgctgatcgtcaataaaccagccggaatgctggtccatccgacagtaaaggaagatggcagtactctgtataactatgttgcacattactataaacaacagggattattacacaatatccatcctgtctcacgtttagaccgcaatacttcaggtcttgtcatttttgcaaaagaaccacgaatccagtttctgctttcccagcaggaggtcataaaaaaatatttaggaatcgttacaggaacattaccagctgacagtggcataatagaagctccaattgccagaaaggaaggcagcattattgagcgctgtgtttctccaaacggaaaatatgcccgtactgattataaacttattagccgccgggaacatctcagtttgctggaactgcagctgcacactggccgtacccaccagatacgcgtacatatggcacatatcggctgcccgctttataatgataacctttacggaacaccaggaccgcaaagccgccacgctctgcatgcttattacctgggctttaaccatcctgcaaccggtatttttttagaaatatcctgcgccttacccaacgatcttttcaaaattatatactattaa

SEQ ID NO: 2550 - DNA, 687 bp, Unknown
  Artificiall/Consensus sequence
atgatgattgaattggaggctggttttatggcaagaagagcacgtttcagcgattttgatggagttattacagaggaaatgctttccgatcggcaaagagctattttagatttcattcgtgagcacgtttatgctaagggatatcctcctgcagtacgtgaaattggtaaggcagtgggtttatcttcaagtgccagcgtacacactcatctgcataaattagaagaatatggttttttgcaaagagatccagccaaaccacgcgctatagaattgacccaagacagcagctggcggcagaaaacggtcgttcctgttcctttggttggcaaagtcactgcagggcaacctattctggcagttgaaaatgttgaggagacctatcccattccactagatttgcttggctgtcaagaagatgtttttatgttatctgtttctggagatagtatgatcaaagctggtatacttgatcatgattacattgttgccagaaagcaaaattttgctaataacggagatatagttgttgctcttattgatggtgaagaaacaacagttaagcgttattttcgtgaattacgttcaattcgtctacaaccagaaaatgatgcctatactcccataacaggtactgataatattcaggttcttggtaaggtaatagcagtattcagaatgctgtaa

SEQ ID NO: 2551 - DNA, 918 bp, Unknown
  Artificiall/Consensus sequence
gtgaataaagagtttttggatttagctgaacaactgaaaagttctgtttcctgtactgtgcgtttgaatgagctgatgagtgggcatacatcttttaaaattggcggaccagctgatattctggttttgccggagtccattgaacaattacgggaagttttgaaagtggtcaaggaaactgttgttcctcttactttacttggcaatggatcaaatgttttagtgcgcgataagggcatccgtggtattgttataaagctggggaatatgctgcgggatttttatgaagcagaggacttgttggtctttggatctggttactcactggcattagcttcatataaagcgatggaatgcggaaggaccggaatggaattcgctgtaggtattcctggaagtattggcggtgccgtatatatgaatgctggcgcctatgatggtgagatgcagaatattgtcaattgtgtaaaggttatggatttacagggaaatgaacgtgttcttactgctgaagagctgaactttggttatcgaaaaaccagtttacagaacagtggacttattgttacagaagtaactttaaaaatgccttccggtaataaagatgaaatcaagtctaaaatggatgatttcagtcaccggcgtattagtaaacagccgttagaaatgccaagtgcaggtagtatgtttaaacgaccaccaggatattttgccggtactctgattgatcaggccgggctaaagggttatacggtaggtggcgcccagatttctactaagcatgctggatttgttgttaatgttggtggtgctacagctgctgatgttttacagcttattaaggacgtacagaccaaaataaaagctggtgttggtgttgaattgcagccagaagttttggtaatcggtgaagaataa

SEQ ID NO: 2552 - DNA, 762 bp, Unknown
  Artificiall/Consensus sequence
atgaaaaaaatcgaagcacgtaatattcataaaagttttcaggaactgaacgttttgcagggtatagatcttgatgtcgaagaaggcgaagtcattgccgtcatcggtcccagcggcagcggtaaaagtactttgctgcgctgtttgaacaagctggaaactatcaacaggggcacgatcattattgacggtgagctgcttgctgataccagcagcacaggtgaggtggtatatgcacccggtgacgaaagccgccgaattgcctgtaaaatgggaatggtgtttcagcagtttaacttgtttccgcatatgacagtgctgcagaatttgattgaagcaccggtgcaggtgcagaagcgcgaccgtgcccaagtaatcgaagaagcaaaaatacttttaggcaaggttggcttgtccgaaaaagcggatgtttatccgcggaagctctccggcggtcagcagcagcgtgtagctatcgcccgcgctttagcgatgaagccgtcgatcatgcttttcgatgagccgacatcttcgctggatcctgaattgacaggggaggttctgcgtaccatgcgtgaactggctgaagaaaaaatgacgatggtggtagtgactcatgaaatgggttttgcccgcgaagtagcgaccaaagttatttttatggctgatggcagagtacaggaacagggcaggcctgaggatatttttactaatccgaaaaatgaacgtctgcaggcttttttgcaaactgtgttaaaataa

SEQ ID NO: 2553 - DNA, 759 bp, Unknown
  Artificiall/Consensus sequence
tgtataagcgtggtggcatgcatgcgtgattttatcacttgcctggaatttttgacgcgagtgcgtttttcaaaacggacagattggcgtgacgaagatttttcgcacagtgtgccgtattttcccctggtaggtttggttatcggattccttttggcagccgtaaactatagcctattttatatcgaaacgccgctttttttacgggtaacgcttttgctgctggccgagatcattattaccggcgggttgatgtacgatggttttatggatactgctgacggcgttttttctgcccgcagccgcgagagaatgctggaaataatgaaagacagccatgttggttctaatgctgtattggcaataattattttgctgctgctcaaaatagctgcctatcttgaacttagcggtgaaacactgacctgggttttactgacgatgtccgttgcgacacgaacttttatggtagtttttattgtcaattttccctatgcgcgtaaagaaggaatagggcatatgtttaccaagtatgccaaaccattttatacgtatattgcttttgcagtatgcgcaggtattattgcggcctgtggtttacaatatctggcggtggcaggaatatgttttactgtcactttgataatagcgcaatatttaaaaacacagttaggcggacttaccggtgatacatatggtgcactgactgaatgcggcaatgtgatttacttactgacagcagtattcttactaagataa

SEQ ID NO: 2554 - DNA, 591 bp, Unknown
  Artificiall/Consensus sequence
cggcgactgcgggaatggacggtgatggtaatgaaaacgaaagtcaggggaaaagcatttgtttttgggaaaaatattgatacagatcagatttatccaggtcgttttgtagaatatacggatgtagaagatataaaaaaatatgcgatgtacggcgctgatgagagctttgtaaaaaacttcgatccgggagatatcattgtggccggaactaattttggctgcggttcatcgcgtgaacatgcggcaataacattgaaagcagttggtgctggagctgtactggcagaatcttttggcaggatatttttccgtaatgctattaatttaggcgtacctgttattacctgcagcgagatcacgaaaattattgcagagggtgatgaagtagaggttgatattgaggctggaataatcaaaaacctgactacgggagcaacagctgcagctgttccgatgtcaccttatattatgaacattctgcagagcggcgggatcaaacctatgatcaaagcgatgcaggagactaaaaaagtaagaaccggtgacggcgctgtaaaattacaatgtaaggatttttttgaattataa

SEQ ID NO: 2555 - DNA, 819 bp, Unknown
  Artificiall/Consensus sequence
atgctgactgacattgcgcttggacaatattacccgggaaattctctgattcataagttggacccgcggacgaagatactgataacattatttttcattgtcgctatttttctggcctcaggagccgtatcttatggaatactttggggtttcgtatttttgattattcttttatcacgtctgccgctgatgctggttctaaaatcaataaagccgctgtggatcatcattgttctgacaatggtaatccatatgtttacagggcagggtgaaaatgtaattttttcctggaaattttttaaagtaacgcaggaaggtctggaaatgggcctgaaaatgtcgatgcgtctgattctgctgctgctgatttcttcgatactgacatttacgacttcaccaatagttttgactgacgggatagaggctctgctgcgcccatttaaacgttttggcgtaccagcgcatgagctggcaatgatgatgacgatcgccttacggtttatacctacgctgcttgaggaaacagacaggattatgaaggcacagaccgcacgcggggctgatttttccagcggcaatctgatgcagagagccaaaaatatgctgccgcttttgatacctctttttatcagtgcgttcagacgtgccgatgatctggcggtagcaatggaagcacgttgttatcgcggtggagaaggacgcagccgtatgcacgagctcgtttattatggacgtgactatgcggcattagcgacagtgtttgttttgattggtctgatggcgtttattcgctgggggaacgcgctatgcgtactctga

SEQ ID NO: 2556 - DNA, 522 bp, Unknown
  Artificiall/Consensus sequence
agcgctgatacaaataaagctgtaaaaggaagtgacgttatgaagtgcccgttttgctcttatcgtgacagtcgagttgttgattcccgtgctgtggatgatggcgtttctattcggcgtcgtcgagaatgtcctgattgtggacgcaggttcactacttatgaaaaatatgaggaaactcctttgatggtaagtaaaaaagatggacgtcgggagttgttcgacgctaaaaaacttttgagtggattgatcaaagcttttgaaaagcggcctatttcttatgagaaaatccaggaaattgctgagcatatcgaacgggaactgaggatgcgcggagaagcagagatcaggagcgaagttatcggcgaagcggtaatgaatcatttagagaaaactgaccagatcgcttatgtacggtttgcttctgtttataggcagtttgctgacgttaataattttatgcaggaattacaacgtattatgaaaaacaatgaaagtattgatcggagtgataaggaatga

SEQ ID NO: 2557 - DNA, 1104 bp, Unknown
  Artificiall/Consensus sequence
atgagtaaaattttgatttccggttactacgggtttgctaatgccggtgacgaagccatgcttactgctattatagaatcgttgcggcaagtggagaaaaacgtagaactgaccgtgttgtcaggcaatccggaagacactgcggctaaacaccaggtttgcagtgtatatcgcttcaatccgttagggattattcgggcgatgaaagattctgaattgattatttcaggaggcggaagcctgcttcaggacgtgaccagtaaacgaagtttattatattatcttagcattattggattgggaaaattttttggtaaaaaagtaatgctttttgctcaaggcattggacctattagagccaaatgggctcgaaaattgacaagtttggtttgcaatgaggcagatttgattacagtaagagatagtgagtctgcagcggaacttattgaaatgggcgtaaaacacgagaagataacggttacggctgattcagtactttcgcttaatcccgtaactaaagaatgcgggcagtacctgctgcaggaggctggtgtagatttaaccaagcccgtcataggtatttctgtacgtccttggtctggtgacagtcaatgttttcaggttttggctgaagctgcttccaaattgcagcagagctatggggcgcagctgattttgttgccgctgcagtattctgttgatgtaaaagcctgtgagaaactgcgtaaagctttggtttgccaaaaggatatatttttattgaatgaaaaatataatactgaggaatttctttctatcataggaaattttgaccttttgattggaatgcggctgcatgcactggtttttgctgctgtaatgcaaacgccgctgctggcaatatcttatgaccctaaagtagatagctttgtaaacgctattggtgaaaaacctattggaacggttgaaaaaattgatagagatacgattgttcaggctgctgtagctggttggcagaaaactccgcttgaacaaaataagaatattgaaattttgcggcataaagcgcagatcaactctgataaagcttttgctttgctaaaaaaggttgaagaaaaacgatga

SEQ ID NO: 2558 - DNA, 954 bp, Unknown
  Artificiall/Consensus sequence
atgtatgatcaccaagctaaaaaattaaatgagcaaggtacgtttaaagaaatagtagtcgagatatcagcccgccagctttctgctaaatctgaaactttacggcaaatgagtatgtttttgacgcaggcggtttttatggaggtttgcgtccatccaaaaccaggcttagtcacccgtcatggcggcggtgctcatacagatatgagtattttgacttttgctgccggttctgcggttttggcaaaagctttcagtgatttacagattttagggatgaagcataatggaaattatcaggagttatttggaaaggtaagacgttacggcgtcagtgcggagcaggagctgctgcgcgtgacgaaaggagtcaatacccaaagaggcattttatttgccggtgggctattggctgctgccgcaggggctgccatgaataaaggtctggacagtaaagcactgtgctctatcgtggcagaaatgacgcaggggctgacagagaatgagctggctggactgcaggcagaccgacctttgacggcaggagaaagattatatcaggcttatggtatcacgggtatccgcggcgaagtggaagcaggatttcccagtgtacgacagaacgggttgcctggcttaaaggaagcgtttgccaaaggcgctggactgaacgatgctttggttcatgctctggttcatttaatgacggttgtgcaggattctaatgtcatctggcgcggcggttatgcgaagctgccgtttgtacagcagcgtgccagagatattttggcgcagggaagtatttttactgattctggacgccggctgctggcagaaagtgaagaacttttcaggaatgaacggatcagtcccggcggcagtgccgatctgctgtctgttacggctgcgttatatttagttgaaaacaaggaattccccgttgcgattatttag

SEQ ID NO: 2559 - DNA, 417 bp, Unknown
  Artificiall/Consensus sequence
atgacagataagaagcaggatgagaaaagctttgacagttctaaaatcaatacacaggaactgcagaaatataaacaggattacagcgagcgcagttttaaggaaaaactgcggaaatatgccaaaataattggtgtaggggcagtttataaagtgctgcagctgtggtatgttttacagaaacctgatgtgccgttgaaacagaaagcacttattacgggagctatcggttatttgattgcacccttggattttattcccgatttgacgcctgttttaggttatagtgatgattttgtggctattacttatgctttattgcaggttcagggatatgtggatgcagaagttaaagaaaaatctaagcattttattgaagatattttcgggactgatgctgtcagtgaattagactaa

SEQ ID NO: 2560 - DNA, 735 bp, Unknown
  Artificiall/Consensus sequence
tgggggtggatgaagatgcttaaagtgcaggatttatttgtagcttatggaggcatcgaagcgctcaaaggtatttccctggaagtgccggaaggtaagatcgttacgctgataggcgctaacggggccggtaaaagcaccttgttgcggaccattgttgggctggtaaagcctaaaagtggtactatcagctataatgaacagaatattaccgggcttaattcacagaaaatcgttaaaacaggtattactttagttccggaaggacgaagggttttcccgaatctgacggtcctggaaaatttacaaatcggcgcgtatatgcgcaatgataaagaagaaatagccaaagacatcaaatgggtatatgaattgttcccgcgtctggaggaacgcagctggcagatggccggcactttatccggcggtgagcagcagatgctggctgtaggcagggcactgctgtcgcgtcctcagctgatgatgatggacgagccgtctttaggactggcgccgctcatcattaaagatatttttaatatcattcaggagatcaacagcagaggtatgacgatccttttgatcgaacagaatgctaatatggcgctgaaggtggctcatcaggcttatgtactggagactggcaaaataactatgagcgggaccggtcaggagcttttggaaaaccctgatatcaaagctgcttaccttggcaaaaaaagaaatcagaaataa

SEQ ID NO: 2561 - DNA, 861 bp, Unknown
  Artificiall/Consensus sequence
aataattataataatttaaagaggtaccttatgttcaaaatattcgttatcatcattatagctgtaggtatctttttttggtatcctaccagtggagaccccatcaaaaaagagattctatcgccaactacacagcattctgtgcaactgccgcctgctgaacacagtaaggtaaccgtttttttactttctatcttacctccaaaacaaacttggccagatccgatacaaaaaatctggctaagcctaaatattgaagaagctgtccaagaacgcactaacgatattgagtgggttcctatcacagatatccctattgaaatgcagcaagccttactggccattgaagatcacaatttttacaatcatggcgccatagatgttgacggtatcctgcgtgctacattagtaaatattactgccggagaagtagttcaaggcggcagtacaattacgcaacagctcacaaaaaacctttttctatcacaagagcagactttgatccgtaaaactgaagaagcgctgctttctctggttatggaacagcattacactaaagaccagcttttagagatttattttaatacaacttattttggtgccggtgccactggcatcaagtctgcagcacttacctattttgataaattacctcaggagatgcagcttgccgaatgtgctattattgcggctcttccttatgcaccatctgcactcaatccactagaaaatcctgaaggctgtaaaaaaagacagcgtttagttttgcagacaatggtaaaacgaggttatattggcacaactttagcagaaaaaacctctgccgaaccagtattccttgcaaatggagcaacattctaa

SEQ ID NO: 2562 - DNA, 426 bp, Unknown
  Artificiall/Consensus sequence
ttggtattgattataagcattttgtggcctggaaaggggaggactaaaatgcaggcaaagtctttttccttaggagcgcaggaatatttgctggaagctgtggcagtacgctgtggtgatgatctgacggtcgttatcggcggcggtgaaaagcagcatatcggtgctgtcgccgtaggcgtaccgcgccccagcttaaaagataaaaatatagtttcttcttcggcatcggtactgtgcctgacagggcataaggaagacctgctggcacgcaaagccgccttagaactggccagtatgcttggtcatactgttacagtgaccgtaggcctgcatatcgatgatgcgtcggctgaggcgatagtgatgctggaagctaattttcaaaagctgttacggcagatttgcctttgggctgctgcctga

SEQ ID NO: 2563 - DNA, 456 bp, Unknown
  Artificiall/Consensus sequence
gtgagagacgtgaaaggtatcagacacggcaagatcaaagaaatcatcgaacacagcaaaatcgaaactcaggaagatttggcggctgctttacgccacgacggtatcgaggtaactcaggctactgtttcccgcgacatcaaagagctgatgctcattaaagttccggatgccgaaggcaattatcattatgcttttcctaaagagcataatatgctgctgactcccggacgtctggaacgtactttccaggattctatcataggcatgcgtgcctctgaaaatctggtagttgtccgcagtcttcccggtactgcacaatcggtagcttatgctattgattatatgaaatggccggaggttttggggactgttgctggtgatgatactatttttgttgctgtcgattcaaaagataacactgtaacctttatggaacgctttaataatcgctga

SEQ ID NO: 2564 - DNA, 417 bp, Unknown
  Artificiall/Consensus sequence
aaaactatgtttgggaaaaataaaaaagatgtagtagcagtaagcactttgcctttggaagaatttgagtttttgcttggaagaaattcgatcctgtgcggcaatttgcagactaagggcgcatcgcgtattgatggtcactttaaaggcattattgtttcggagaacgatgttttaatcggacccaacggtgtgatagaagcgaatatttttggggaaaatgttactgtggccgggaatgttacaggtaatatagtggcccgcggcactttagagattttagcctctggagttttaaacggtgatattaaagcgggaagtttagttgttgagccgggggccgttctgcgtggcaacataggcggtatcgaaggtattgaaaaccctgagctgtctcaggctggcgtttctgagtaa

SEQ ID NO: 2565 - DNA, 660 bp, Unknown
  Artificiall/Consensus sequence
agaataaataaaacggaaggtgggctaatcgtgaaaccgcaggggttattattagttttgtccgggccgtcaggagccggcaaaggaacgatttgtcagatgcttagggaaaagcttcccgacttggcttattccgtttcagttactacaagacaggcacgtaacggcgaagttgacggcgtgaattacttttttaaatctgtggaagaagtaaagcagatgatcgcagagggagaactgctggaatatgccgaggtttatggaaattattacggtacgccccgttcttatgttatggaactgctgaatcagggcaaggatgttattttggagattgatatccagggcgcgatgcagatcaaaaaacgctttcctgatggagtatttgtgtttatcgtaccaccgtcacttgatgaattatgctcgcgcatttataaacgcggcacggacagcgaagacgttattaaacgccgtttagcttcggcaacaggtgaactggcttatgccaacgaatatgattatatagtcgtcaatgatgtggctcagaaagctaccagcaaagttttgacgatcatggaagcagaacgttaccgtgctgccagaacttattttattatcaatgaaatttgccatgcggcacataaggagagagaaatatga

SEQ ID NO: 2566 - DNA, 459 bp, Unknown
  Artificiall/Consensus sequence
caaggaggagaaatgatgattactttagacgctattgaaattcaaaaaattattccgcatcgttacccaatgcttttggtagatcgcattttagagttggaaccgatgaaaagggctgtcggtgtcaaaaatattaccatgaacgaattgcagttcttaggtcatttccctggtgaaccgattatgcctggtgtgctcttaattgaggcaatggctcaggtcggcggcgtggcgatgctgtatccggaagaaaaccgtggcaaaattgcggtctttggtaagatcgataacgtacgttttcgtcgtcaggtagtaccgggggatcaggttattactacaactgaagttgtaaagatacgtggaaatatgggcgttattcattgtgaaggcaaggttgatggtcaggtggcctgtgagtgtgattgtacttttgcgattatggatccaaaaaattcttaa

SEQ ID NO: 2567 - DNA, 678 bp, Unknown
  Artificiall/Consensus sequence
gttagcatgggacagcctaaaatcacagagatagaggcgcagcttggcgagtgggaatttttaaaagaactgccgcaggaaatagatggctttaagttaacaatgggacagggaatagacggacagatcttaacgattgcttcatatagtaatgaagcaatgcacagcaagcttgatttgatttatacttcggaaacctttgattatgtacctgtaaaaacgattggcatgcatacgttcagagatattcgctatttttgccgcgacagggataaatttgctaaaatgatgcatgaaaagctgccggagcttttagcggacgtgaacagggaaaagaagcatcagatgggaaccttgatagaggaagccggacttctgaactgggcgtataccggcaagctgccgcagaaaataggtgcttttgaattgtatataactcctgacaatcccatcgattatatcaatggttcaacgctttttattgattacagtgactttgaacatggtaatcagctggtgtttttctataatagcttccgcgatgagttttttgctgaaacgaaaaaacggtttatgacaggaataacacatgaatttgattgccgaaatttaaaagatctggaaaatctgctggataataatctggaacaggcattgcaaaaacttggcaaagcgtaa

SEQ ID NO: 2568 - DNA, 666 bp, Unknown
  Artificiall/Consensus sequence
atgaaacttattgttggtttgggtaatatcggaaaagaatacgaagctacccgtcataatattggctttatggtgctggatgaactggcccgccgctggggtgtaaatacttggaagaatgaccgcaatgctctgtgcggggaatatcgcatacctgaaaaagtactgcttttaaagccgacgacatatatgaatctgagcggtgttgcagtaggtgcctatgcgaactttttcaatgttgatccgcaggatattgctgtggttcaggatgatcttgacttgccgacagggcaggtcagagttcgccgcaaaggaagtgctggtggacataatgggattaaatccgtgcaggaacatttaggaacaggtgaattcccgcgtttcaaaattggtatcgggcatcctgcccataataataaagctgtggtcaagcatgttttacagcgctttggtgctgaagaacaggagcttgtagcggaggcagtggggaaaatggcggatgctttagagttgtggctgcagggagatatggatgctgtaatgcaggaatataataaaaagccgcctaagcaaaagcagagtcaaatgaaactgttaaagaataaatttggtataatttcaaatatttttctttgtctgctgacgaatcagatgtatacagaataa

SEQ ID NO: 2569 - DNA, 642 bp, Unknown
  Artificiall/Consensus sequence
tcgtgcgtgtgggtacggccttatttggtaagcgcgattacagtaaaaataaatgagcatgaaggtatggtgaaatgtatgaaattttttgatcgtatctctgaaactttaggtttatatgaagaggaagatgatgaacttttagaggaagaggaacctgtaaaaaaggctgaaacagctcctaaacggattccccgcagtacgcctgccgtcagcagggcagcactttccgccgagtctgccgctttggaaaaaagtgaagccagaagtgaagtgccggctgagaaaaaatccttcttcagcaaaaagaacgtccaaaattcgcctgaaggcaaaaccatttccatgccgcttgctcaaaagcaggtcaaggtagtggtgctggaaccggctaattttgacgattcgcaaaaggttgccgattatctgcgcaacaaccagcctgtagtagtgaactttgaaggtactgaaggcctggtgaccaaaagaatgaccgactttatcagcggtactatttacgctttaggcggcagtatgaaaaaaatcggccgtaatattctggtctgtgccccgaaaaacgtagatatcgacgccagcgtcaacatttatgatgaaaagggtggtcaaccgtggaaaaaataa

SEQ ID NO: 2570 - DNA, 435 bp, Unknown
  Artificiall/Consensus sequence
atggtaaacgatatggataaaatgtttgtacgtgttccggttgcaataaaagcaaaagtaacagaagatctcaagttgaaaattattggagatgtccaaaacaccataaaaacgattaatctggatatcgagcacttcgaattccaagccaaaaaagctctttctcaggccgccagcgacctgagcgtacttccttcactgcgtgagcagattgaaatggaaagaaacaagatcaatgccgctaaagcagaagccgaagataaacttaaacgcgctgaagctttggagatcggtgcggagatcggtcacggtacacttgaacgtactgtcgagatcaccataggcactgatatcgacgctctgatgggcgccgagatcctcactgaggatggcaagatcattgctgttcagcgaatgatatggaaaaacaagtag

SEQ ID NO: 2571 - DNA, 915 bp, Unknown
  Artificiall/Consensus sequence
atgaatattgaccaaaagtattttccggaattcaaacagcaacttatcgatgtaggtgacggtattaagatcaacactttagttggcggcaagggcagtgaagctattttactgctgcacgggcatcctgagacacatttgatctggcggtttttgacgccgggtctaaccgggcattatacggtagttattacagatctgcgtggatatggcgacagcagcaagcctgaaggacttccggatcatgctaattattccaagcgggctatgggagacgatcagtttacagttatgagcaagctgggttttgaaaaattccatggtgtcggtcatgatcgcggggcaagagtactgcacaggatggtgatggatcatccggaacggctgctgtcttgtacgatgatggatattttgccgacttatgatatgtaccgtgataccagtcaggagtttgcgactaaatattggcactggttcttttatattcagggcaaagggttccctgaaagagtgctggcggcagatcctgagtattttgttaattataatttgaatttgaagatcgggccggccgctaaaagcaggttccctaaggagattttagacgaatatgtacgctgtctgcgcgatccgatgactttccatggtatttgcgaagattaccgtgccagtgctactatagatatggagatggataaagcagatcgtgaacagatcattcaggttcctgttttggctttgtggggtaaggacggtgttgtcggtaagctgtgggatgttatgagcggctggcaggaaagggcggctaatgtagaagggtttgctgtaaatgagtgcgggcattttgtaccggaagaacagccggaggtagttttagaggcgatgctgcaatttttagccaaatatccggcttga

SEQ ID NO: 2572 - DNA, 567 bp, Unknown
  Artificiall/Consensus sequence
ttccgcgttataataaagacaaagaaaacgccgaataaaaaacggcgcaaggaggtaaaaaacatgactagaaaaatcctggcgatcatcgccgccgcaatctgtacattagcaatcacagcaaccgcttttgccgctgagttcatcaacgccgatcaggcacgcagcatcgctgcacaatgggtacctgccggcagcactcatctggtaactaaagacgaaagccacaaatacgcagcttattacgaagtaaaattctacgacaacgctaccaacaccgaatatgaagttgaagtgctcaaaaacggcggtgctgtaaaagaattcaaaatggatgcccaaacagttctcggcagccccagagtcatactatctgccgctgatgtccaggacctcgttcgcaaagaattccccaacgcaaccttcactaaagtaaaacttgacagcgacgacggcctttatgaatatgagttgaaattctatacacccgaattacgcggcgaaatgaaattcaaccctgaaaacggcgctctgatggaaaaagaacttaaataccaagttcgctga

SEQ ID NO: 2573 - DNA, 474 bp, Unknown
  Artificiall/Consensus sequence
ttaatgagtgaaaacagaaaaatcaggtttacaactaataaaggagaatttatcgtcgaaatgttcgaagataaagcacccaaaacgactaaaaattttattgaattgacagaaaaaggtttttataatggcgtagcatttcatcgtgttatcgacggctttatgattcagggcggtgaccctaccggtactggtatgggtggaccagggtataaaattgatgacgaatttggtgaggggctgaagcatgatgacgaaggtattctttcaatggctaatgccgggccaaacactggcggcagtcagttctttatcactttagcacctacaccgtggcttaacgggcatcatgctattttcggcaaagttgttgaagggatggatattgtacgtttgattggtgtagtacctacggattttcgcgatcgtcctaaagatcctgtaattatggaaactgtagaggttataaaataa

SEQ ID NO: 2574 - DNA, 519 bp, Unknown
  Artificiall/Consensus sequence
atgcgctcctccactgatacgacaactaaaaccatgcttgtcctggcactgctggcagcgctggcagttttgctgcgtctgggcgaaaacctgctgcccctgcctgtccaattgggcgcaattcgtccgggactggccaatactattactattttatgtttatatttgttcggtctgcgcctgaccgggctttttttgactgcccgcgttcttctggtcggacttttgagcacaggcctttttacacctggttttcttatcggccttggaggaacgcttttaagcctgctgctgatggaagcaggacggcgccatcagcttttttcaccctatggtatcggcatcctgggggctgccgcacataatacaggtcagatcctgactgcttccctgataatgcaaagttccgctttattctccctgctgccgttactgctccttttatcattgcctttcggattgctgaccggtgctgttgccgcaaaaacattaccgttcctgaaacaatatctgcattga

SEQ ID NO: 2575 - DNA, 1038 bp, Unknown
  Artificiall/Consensus sequence
ttcggctggatcgtaccttcagtctgtggcgctttattaggattgctttggaaactctggttccagcacaaactaaataatccattttcaaatttatgcgcagtttttttaactgcgcatttttatttcacaaataaaacagcatctatcaagcaggaaaagagttataataaagaaaaggagtgtgatattatgacacagacgaacggcttttttactacctcagaccaggcgcatctttattatgaagttcatggtaaaggtcagccactttttcttgtacatggctggcagtgttcttccagattttggcagcacaatattccagaactttccaagcactttcaggtaatagttatggataaccgcgggcacggcaaatcctccaaaggtctgcagggccaaatcgttgcccgttacgcacaggatatccgcgaactttctgaatttctgggtctgaaaaattttatcctcatgggctggtctttaggcggacctacagtgctttcctattggcagcaatataaaaccgacagcaatctgattggtctggggctgatagatatgacgccattccctttcagtcctgaagaatggaacagtcagggtttgcgcaactacaatatggaagggttcaatgcacaggtcaaccgattggtcaacgaacgggaagaatattttgaattttttgcaaacgcaatttttaaagacggcaaacgaccagccggcacagactgggtaattgaagaattccgcaagctgccgccctggctctcagcagccatctacagcgactatattgcaacagatttcactaacgttctgccaacaataactgttcccacgctggtcgtcaacgccgacggacctgtttttgcctggggaatcaagcagggcacttacctgacgtctctaatccccaatggtaaatttgtagcttttacagaaagcggtcatatgctcttttatgaagaagcagaaaaattcaatcaaacagtcagtgattttatcaaagactgtctgccccagaatgtttaa

SEQ ID NO: 2576 - DNA, 1746 bp, Unknown
  Artificiall/Consensus sequence
gtgcggttaatagattttattactagaggtctaaatacttgtacggaaataaataaaaaaaattttggaggtgtattttttttgagtaaaatacaaagtaaattaaatattattcccttgggcggattgggggagatcggtaagaacatgacggtattccgttatggcgacgatataattctcgttgatgccggcttgatgttccctgaagatgatatgctgggaatcgatcttgttattcctgatattacttatttagtggagaacaaagacaaggttaaagctatcttcctgactcatgggcacgaagatcatataggtgctttgccgtatgttatgaaacagatcggcgctcctgtttacggaactgctttgactttaggtattcttcagggaagattgaaagaaaacggggtcagctctgaagcatgcaaaattatcaaacctggagataaaattcacgcaggaaatttcaaagtggaatttatacgtgtcaaccatagtattccagatgcagttgcattggcgatccatactcctattggtattatcattcataccggtgatttcaaatttgaccagactcctgtagatggacaggtaactgaatttaataaattcgcagagttcggtgatcagggtgtactggctttaatggctgacagtaccaatgccgaacgccccggttatacgcaaagtgaaaaaatagtcgggcagacttttgatgatgaattccgttatgccaaaaaccgtattattgtcgctaccttctcgtcaaacgtacatcgtatccagcaggtagttgacagcgctgttcgttataaacgtaaagtagcagttatcgggcgcagcatggtaaatgtagtaaatatttccatggaattagggtatttaaaaatacctgaaggcgtactgatcgacattgatgagagcaacaactatactcctgataagatagttatcattactaccggcagccagggagagcctatgtctgctttaacaagaatggctatgtccgatcataaaaaagttgatattgttcccggagacactgttattatttccgcaacacctattccaggcaatgaaaagctggtttccagaacaatagaccacttgtataaacttggtgccgatgttatttatgaaaaaagcaatggtgtacacgtttcaggtcatgccagtcaggaagaaatcaaaatgatgcacaatctggtgcgtcctaaatttttcattcctgtgcatggcgaatacaggcatttgatcaagcatgcacagcttgcaggcagtctgggtatgccgcgcgagaatatcgtcgtaggcgaaaacggttcgatcattgaattgacacgcaatagtattggtatcaatggccgcgttccttccggaaaagtacttgtagacggactcggcgtaggtgatgttggcaatatcgttctgcgtgaccgcagacagctgtcccaggatggtatcatgatagttgtcgttactatcgataaggatacctgcactgtagtttccggtccggatatagtttctcgcggctttgtttatgtgcgtgaagcagagggcttgatggaaactgctaaagagaaagttcagcaggctcttgataaatgcgaacagagcaatgtttctgaatggtctgttataaaatctgctgtccgcgattcacttggcagatttttatacgaaaaaacacgcagaagaccaatgattttgcctattataatggagatctaa

SEQ ID NO: 2577 - DNA, 3534 bp, Unknown
  Artificiall/Consensus sequence
gagcagcaaaacggacacagaggaggtgcgggcatgagcgaaggcagccgcgcggggagagacttcgtccatctccacatccataccgaatacagccttctggacggtgcctgccgcatcgaccagctcatggaccgtgtcaaggagtgcggtcagaacgccgtcgccatcaccgaccacggcgtcatgtacggctgcgtccagttctacaaagcggcccagaaggcaggcatcaagcccatcatcggctgcgaggtctatgtggccacccgcacccgcttcgataaggtaaataagatcgacggcaacaaccatctcatcctcctgtgcaagaatgagatgggctacaaaaacctcatcaagatggtatctgcggcctttgtggaaggcttttactccaagcctcgtgtggacaagcagctcctcgagcagtaccacgagggcctcatctgcctgtcggcctgccttgcgggtgagatcccgcaggccattctggccggagattatgagagggccaagtccacggcgctgtggtatcaggacctgttcggcaaggaaaactattacatcgagctgcaggaccacggcctcgaggaggataacatcgtcctgccccagctcatcaagctggcccgggagaccggcatcccgatggccgccaccaacgacgcccactatctgcggagggatgatgccaagatgcagagcatcctgctctgcatccagaccggaaagaccattcaggacgccgaccggatggagttccagaccgatgagttttacgtcaaaaccaccgatgagatgtatgatctgttcgcaatggcgccggaggcctgtgccaacacccagaagatcgcagacgagtgtaagtttgactttgatttcggccacaccaagatcccctattacaaagccccgaacgggatggacaatcaggcattcttcgagaagctctgctgggacggcctcgagcgccgctacggccccgacgtcccgcagtccaacaaggaccggctgacctacgagatcggtgtcgtcaagtcgatgggctacaccaactactacctcattgtctgggactacatcaactacgccaagagtcagggcatcccggtcggcccgggacgtggctcgggtgcgggcagcatcgcggcctactgcgtgggcatcactgacatcgaccccatccgctacaacctcatcttcgagcgtttcctgaaccctgagcgcgtcagtatgcccgatttcgacgtcgatttctgctacgagcgccgtcaggaggtcatcgactacgtcaaccggaagtatggcgcggaccatgtggcccagatcgtcaccttcggtacgatggcggcccgcaacgccatccgcgacgtgggccgcgtgatgggactgccttaccagagcgtggatgtcgtggcaaagcaggtgcccatggagctgaaaatgacgctgaaacgcgcattggaagtctcgccggagctgaagcggatgtacgacagcgacccgcaggtcacagagctgatcgataccgccctgaaggtggagggaatgccccgccacgcctctacacacgcggctggcgtcgtcatcacaccggagccgacggactactatctgccgctagccaccaacgacggcctgcccgttacccagttcaacatgaccgagatcgaagagctgggtctgctgaagatggacttccttggcctgcgcaccctgacggtcatccgggacgccgagctggccgtccagaaaaaagacccctccttctccatccggaagctggattacgacgatgcggcgacgtataagatgctgggacagggtgagacggagggcgtgttccagcttgaatcctcgggcatgaagcaggtgcttgtgggtctgcagccgcagaaccttgaagacgtcatcgctctcatcagtctttaccgccccggcccgatggactccatccccacctatctgcgcaaccgccacgagccggacaagatcagctataagacgccccagctggcgcacatcctcgacgtgaccaatggatgtatcgtctatcaggagcaggtcatgcagatcttccgcgaactggcgggcttctccttcggacaggctgacaacgtccgccgcgccatgagcaaaaagaagcacgccgtgatggaggcagagcgggagcattttgtccatggctgtaccgagccgggccacgagtgcccgggctgcgtcgccaacggcatctccgaaaaagtcgccaatgagatctacgatgagatgtcgagctttgcttcctacgcattcaacaagagccatgcggcctgttacgcctacgtcgcattccagacggcctacctcaagtgtcattaccccagcgagtttatggccgcattgctcaccagcgtgctggacaataccgacaaagtcattgagtattcgggtgagtgcgcccgccttggcatcaaggtgcttccgccggacgtgaacatctcgaacggcggattcacggcggatgacggcaagatccgcttcggcctgaacgccgtcaagaatgtgggtcgcaacctcatcgagcgggtcgtggaggagcggaaggaaaagccctacgcaagcctctacgatttctgcaagcggatgcacggcaccgagctgaaccgccgggccgtggagtgcctcatcaaggcgggtgcgttcgacggcatgggcatcaaccgccacagccttgtggaggccgtggacggcatcatcaagagcgtggagagcgactcccgccgcaacctcgaagggcagctcgacctgttctcagtgatgagcggcgaagcggaggctgctgatgacagctacgagatcaagccgttcccggagtacagccacaccgagctgctccagcaggaaaaagaggtcagcggactctatctgtctggtcatccgctggatgcctaccgggagcagtcggcccgctttgcctccaacagcatcaaggagcttaccggcgaggatgcccataggctggacggcgatcacgtccgtatcgtgtgtaccatcgtcaaaaaccggatgatgaccaccaaatccaacaccatgatggcctttaccagtgtggaagatctgaccggcacgatggagatcatcgtcttcccgcgggttctggataccttccgtgacgcgctcaaggagaacgccgtcgtggtcatcgaaggccgtctctcggtgcgggaggatgagccgtccaagctgatggcggagagcatcctgcccatcgagggctatgaccccaagcgtccgcaagccaaccgcccgaacctcatgcgggatgctgcccaaaggctctatatccgtctgccgtcccgcagctgcccggagtacgcgaaggtcatcaatcttcttgagatattcgatggcgatatgccggtcattttctatctcgaggacgtcaggcagaagcttgccgcaccccggaggctgtatgcttcgggccacccgctgctgtttcaggagctgaagcgcctgcttggcgagcacaatgttgcaacaaaatga

SEQ ID NO: 2578 - DNA, 2577 bp, Unknown
  Artificiall/Consensus sequence
ttggaacataaaaataagcccactccggctgcgcggatctgggcgctctatctgatcgtcggcgtgctcttcatggcaggcgtcgtctttttctcgaactggaaagcgctgtgcacaacggaagagcgcttttgccagatcctcaattttgtcaaatcgcagtccacccgctacgaaaaatacaacgataccgttgcagcgaagacccttcgccgcacagcggtctcggtgcaggcgctggtcgatgaccccgcgctggacttctccgacccgcagtgcctgaaaaaggaagccgaacggctctggctcaccggcatctccgtccttgacccgaagggcacgctcctctgcgagtataccgcgaacggggtcggctatgctcggtttggcgaccagctcaggaccgatgccgctctggacgtcttccgctacccgcagaagacctatatgaagcgcgtcctgctggaagacgggtctgtcgtggatgtgacggcacaccgggcaggcagcggcgcggccatcctgctcacctatcggtacaccccggcggcgcttgtcgaagggacggcgctgtcggtccagagcattttggatggctacccggaagagaccagcggcaccctgttcatcgtgcagaacaatcaggtcatcgcctccaaccgcccggagctgatcgggcaggacaccacggacagcccgacggtacagaagattcgcaaagtcggggtcgcggagatgctgacccacacccgcggctgggacggctccggctcctatttcgggatgtacagccacgggcgtacctttgacctctatgcgtatacagacggcagaacgatcttccgtgcgtccgtctccaccatcctgatggcactggccggttatatcctgctcgtggtcgtccttcaaacgctgcgcaggcgctcggcacaggagatggagcagcagaaaaaggagcaggagaagaagtatcagacccagctggaggagcagaaccgcaagctggagatcgcgctccagcacgagggggcagcaaaccgcgccaagcgggagttcctgttcaacatgagccacgacatccgcaccccgatgaacgccatcatcggcttcacctctctggctgcgacccacatcgacaaccgggagcaggtgttggactacctgaaaaagatctccacttccagccagcacctcctctccctcatcaacgatgtgctggatatgagccgcatcgagagcggaaaagtaaagctcgaggagcgcgcggtgcatctgccggatctcgtccacgatgtgcgctccatcatccagcccaatgtctcggccaagcggctgtcgctcttcatcgacaccatggatgtggagaacgaggacatcatcaccgacccgctgcggctgaatcaggtgttgctgaacattctgtccaacgccatcaagttcacccccaccggcggcatgatcagcctccgcatcgcccagaagaacgatgcgcccaccgggcgtgcccgctatgagttccgcatcaaggacaatggcatcggcatgagcgcggagttccagaagcacatctttgaggagttcagccgggaggaaagctccaccgtcagcggcattcagggcaccggcctcggaatgtccatcaccaagaacatcgtggacctgatgggcggcaccatcgccatcgagagcgagctgggcaagggcagcgagttcatcgtggacctctgctttgcacgctgtgagcagaaggtggagcagcggcagctcccgcagctggaagggctgcgcgcactggtggcggacgacgacaccgacacctgcctgagcgtcagcaccatgctgtccaagatcgggatgcggccggagtggacgatctccggtaaggaggcggtgatccgcaccaagtacgcggtggagcggggcgatgaattcagcgtctacatcatcgactggctcatccccgatatgaacggcatcgagatcgtgcgtcagattcgcaagatcatcgggcacaactgccccatcatcatcctgaccgcctacgattgggccgacatcgaggaagaagcccgcgctgctggagtgaccgccttctgcgagaagccgctgttcctttccgagctgcgcaagatcctgtctgagccgttctctgccgaggtgtctccccgcctgccggaaccgaaggcttccgcctttcaggggaaaaagctcctgctggtggaggacaacgagctgaaccgcgagatcgcaatggagtttctgacggaagcgggctttgtggtggattctgccgaggacggcgcgattgccgtccagaagatggagcaggctgcgcccggccagtatgacctgatcctgatggacatccagatgcccaacatggacggctacgaggcgacgcggcggatccgcgccctgccggatgcgaaaaaggccggcatccccatctttgccatgacggcgaacgcttttgaggaagaccgccagaacgcgctgaaggccggcatgaacggccacatcgcaaagccgctggacgtcccccgcctgctgagcatccttgccgatgcactgaaatga

SEQ ID NO: 2579 - DNA, 1887 bp, Unknown
  Artificiall/Consensus sequence
aaggcgatggatgtacgactcaaacgcgccaaagagctggcgggctatgccgtccggctcacaaaggacgagggcctgcccacgatggtgaagcggggcgcgggctttgtccgccgccgcttcttcggcaagagggcgcgctatctgcccggcagaaaggtgctggaagcccagagggccgagatggcaggaaaaaccgccgaggactgcggcctgcccaccatctccatcctgaccccgctgtataatacgcccgagaattacctgagggagtttctggattcctttgtgggccagacggctcccaacggtcagctctgtctcgccgacgcctccgatgacgcccaccccgaggtggagcgtatcgtccgggaatatcagcagaaaaatcaacgcatcggatacaaaaaggtcgaaaacaagggcatcgccgccaacaccaacgccgccgaggcgctggccgacggcgaatacctcgccctcgccgaccatgacgatgtgttggccccccatgccatgtatgcgatgggaaaggctattttgcagctgcgccagaggggcgagccggacggctttgtctacagcgacgaggccctcttctcaaagagcatcaaaaagccgatggtgggccatttcaagcccgattatgccccggattatctgctctgctgtaattatatctgccatctggcggtcttcaggcgggcgctgtacgagcagctgggcggcgagcggcccgcctgcgacggcagtcaggaccacgacctcttcctccgcctcatcgagcagaccggcggcgcggcccatgtcccgcaggtgctctactactggcgggtccacgccggttcgccctccggcggcaccgacgccaagccctatgtggcggcggcggcgaaaaaggcgctggctgaccatctggcccgcaccgggcgcaccggcagggtggaggacggcattttccccagcacctaccgggtgaagtgggacatcgagggcgaccccaaggtcagcatcctcatccccagcaaggaccacatcgacgacctcgagaagtgtctgcacagcatctgggccaagaccgagtgggacaacttcgaggtcatcgtcatcgagaacaactccaccgacccggccacctttgcctattacgaggcggcagagaagcggtacgacgggctgaaggtggtgacgtggccggaaaagggcttcaacttctcggccatcaacaactttgggcggaaagccgcgtcgggcgagtacctgctgctgctgaacaacgacgtggaggtgcggaacggcggctggctcaccgagctgctgcgtccgtgtgcccaccccggcggcgcggccatctgtggcgcgatgctctattaccccgacgagaccctccagcacgcaggcgtcgtcacgggtctgggcggctacgcgggccacagccacaagtacaagaaggccggcggcagcggctatatgttccgcaccgcgacggtgcaggacttctctgcggtcacgggggcctgcctgctggtgaaggccagcgtgtgggacgaagtggacggcctcgacgagaagttcgccgtggccttcaacgacgtggacttctgcctccgggtgcgggaccggggctatcgcatcgcgtggacgccctacgcccagctgacccattacgagagcaagagccggggcggcgatgagaaggatcccgccaaggcggcccgctttgcggccgaacagcagcgtctctacgacattcacggcaaggcggacatccttgacgacccctattacaatcccagtctgacccgcgaccgggaggacttctcggagagcggcgacctgcggaacctgaaagagggaaaagtgactgtgaggtggcggaacgcatga

SEQ ID NO: 2580 - DNA, 2703 bp, Unknown
  Artificiall/Consensus sequence
atgaagcttctgatgcgagatgaagcaaaaggaaaagaacacaccatctttgtcaccatctttgcggcgctgatggtcatgctggtcatcatggtcatgctgatggcctcggccattggggtcagcggcgtcaccctccgactggatgagaacgcggtggacatcctcgacaagcaggtggagaaccgtgcccggtacattgaggcccagctccagcaggcacaggacctgacggagctttcgagctttatcaacgataaggctcggaagatgctggacgaggggatgctctctctcgatacgctggattctaccggcggcgagagcctgcccctgctggaagcggccgctccgaggctgctcaaggcgctccgcgccaagcaggtcagcggcgtcttcctcatcctgaacacccacgactttacagaccgcacctccggcgaccggctgccctgcgtctatctgcgggatctcgacccggaagccgcctcctcggcggacaactccgacgtgatgttcgagcgcgctccggcagagctggtgcaggccttcggcatcactacggacaaggcgtggacgcctgcgcagcagtatctggatggggaagaggatgccttttatgtccggcccttccaagctgcctatgagagcggggagctgaccggagctgcggcggattatggccgctggacgaccctgccctatacgctgctgggcgatgaccgggaggccatcgcctacgcgcagcctctgattttggatgacggcacggtgtacggcgttctgggcatcgagatgctggaaagctatatggacaccaagctcccgtgggacgaattgcagaacgaccaccacggaagctatctgctggcctctacgacctccgacctgcggggcgaggagctgcagatccatgtcaccgccaacaccggcgagcagacgaccgcgctgcagaaggaaggatgggagctgaccctccaccgcgccaagggctactggcattatccgagcggcggtgccaatcaggtcgtcagcatccgccagatcagcctctacaaccgcaacgcccccttctcgggcgaacggtggctgcttatcggcgtggtgggaaggaacgacctcttccgcttctcccagtcggtgacgaatctcgtgagctttgcgatcctgctgacgctgggctttggtctgggctgcgcattcttcgtcagcatcggtctggcccagccggtcgctcagctctcgaaggagctggcggatgcgcaggagcggcatcaggccgtcccggagttctcccgcaccggcatccgggagctggacaggctggccgacgccatcgtgaccctgagcaccgacaactacaaagcagccgtagccgagcgcagccgcattgagcacgagcgcgattacgacgcccttaccgggttgtacagtcgtcaggccttcttccgggtctgcggcgagctgttcgagaagcccagaatgatgcgctgtgcggccctgatgatgacggacctcgataacctcaagaccatcaatgatacctacggccacgactggggcgacatctatctgcgcaagacggcccacagcctgcagcagggcgtgcccagcggcaccgtggtggcgcggctctccggcgatgaattcctgctgctgttctacggctatgagatgaaggaggccgtgcggaaggacatccggaagctggaagagggctttgcccggagcagcgccaccctgccggacggcaagaagctgtgcatccggatgtccggcggcgtagcatggtatcccgacgatgccgccgacctcgacaccctcaagcgatacgccgattttgcgatgtacgaggtcaagcactccaccaagggcgaagtccgggagttcaacatggagcactaccgcgacggcatctacgcgatgaagcagcgcagcgacttcgagatccttgtccgggagcggcaggtggactactacttccagcccatcttctcggcccgggacggccatgtggcggcttacgaggccctgatgaggccccggctgcccgctctgagctctccccagagggtgatggagctggccagcgagatggggcggctgtatgacatcgagaagctgaccctgttccgcgcctgcgagtgctatgaagcgctggaagcggcgggcaaggtggagccggatgccctcgtcttcgtcaacagcatcgccagcgtcagcctgaacgatgaggattgggcgcacttccgtgaggcccacaaagccatcctctcgaagctggtggtggagatcaccgaggaggaggagatggacgaacaggcgctggagcggaagcggaatgccaccggtgcgcccgccgtctttgcgctggacgactacggcagcggctacagcaacggcagcagcctgttgaccatcgcgccccgctatgtcaaggtggacatcgccatcatccggggcattgatgccgaccccgacaagcagcagttcctcaaggccctcatcgaatatgcccgcccccgcggcgtgcaggtgctggccgagggcgtggagacgatggatgacctgcgcagggtgttggagatgggcgtggacctgctgcagggctacggtctggcccgcccggccgcagagcctctggccatccacgaaaaggcggtcagagtcatcgaagaagcggctcgccagcgggatgcatga

SEQ ID NO: 2581 - DNA, 1074 bp, Unknown
  Artificiall/Consensus sequence
atggcacagtttcgctccaagcctttcggtgtgaccaaaaacggtgataaggtggatgagtacatcatctccaatcccggcggacttgagatcagtgtgctgaactacggctgcgtgatcaaaaatctcttcgtccccaccaagacgggccttgtggatgtggtcgtcgggcacgacaccctcgccgactatgaggcagatttcaactcgtccggcagcacctgctgcggtgcgttcgtgggccggtacgccaaccgcatcgaaaacgcggaatttgccctcggcggcaagacctacaagctggaagccaacaacggcagaaatcacctgcacggcaccttcccccggaagatctacgatgtgaagatgttcggcgacacgctcctgatggagaccgaaagcccggcgggcgaggatggtttcccggggaatctgaaggtcagcgtgcggtacatcctcaccccggacaacactctgcggatggactaccgtgtctccagcgatgcggataccatcatcaacctgacgaaccacacctatttcaacctcgacggcggcggcaatgtgctgggccagaagctccgcatctatgcctccaactacctcgagggcaacaacgagacctgccccacgggccgcatcctgcctgtggccggcacgccgatggatttccgcgcaggcaagccgctgggccgcgacctcgacaccgggttctatcagaccaccatggcgggcggcggcttcgaccactgttatgtccttgaccggccccggggcgcgagccagagcctctgcgcgtgggcgtccagcgacaagaccggcatcagcatgaagatgtacaccacccagccgggcatccagctctacaccggcaacttcctgcagaactgcccctcccccggcaagggcggcgtcccgatggaaaaatacggcggcttcgccctcgagacccagcacttcccctgcagcccctcccacccggagttcccctccacggtgctgcgggcgggcaaggtcttccgcgtcaacaccaccctccgcttctttaccggccgtcagtgcggccgtctctaa

SEQ ID NO: 2582 - DNA, 1926 bp, Unknown
  Artificiall/Consensus sequence
atgtccgaacttaccgaccatattatgacgcgccagcaggccgaagaggaaatggcctgcctgcgcaagatattccccatcgtccgtctgctcgaccggaagacattagcggagcagccctgttatccgccgtggaaaaacgcccacccctgcaccagctgtgtgggccgcgaagcgctggccggaaaatgccagtgcaccaagctggaaacgatgggcagcaagctctatcaggccatcgcccgttacgtcgagatcgacggtgagccgtccgttatcgagatggtccttccgctggactctggtgccctgcggacgctccactccgacgagcagctctacacggaccccctcatcggggcttacaaccgccgcttttatgaggaggagctgaagcacaaatacctcaacgccggtgtcgccatgatcgaccttgacgacttcaagctctgcaacgacaccttcggccacgcggcgggcgatgcggcgctccggctcaccgcctctatcatccaccgctgcatccgctccactgatatgctggtgcggtacggcggcgacgagctgctgctcgtcctacccaatatccccgccgagcattttgtccagaagctccggtacatcagcaagcgcctctccacggcccacctgcccgagttcagcaagctgcagctctcggccagcatcggcggcgtgatggccgcagacatccccatcagcgacgcggtggtggtggccgataagcggatgtatcttgccaagcgctgcaagaacaccgtcgtcaccgaggacgtcgcccccaactccgtctgctccgggaacgcccaccgcccgacggtccttatcgtggacgactcgcccatgaaccgggacatcctttccgagatcctctccgatgatttcgaagttctggaagcctccaatggggcagagtgcctcgagatcctggatgcacgcagccccgagctttccatcttgctgctggacatcgtgatgcccgacatggacggcttcgatgtgctgtcccggatggcggcgcagggcctgctcgaagacctccccgtcgtgatgatctccagcgaggactccgcccagaccgtccgccgtgcctacgagctgggcgcttcggactacatcagccgccccttcgacgcccgcatcgtccaccgccgtgttaccaacatcacccggctctacgcccgtcagcggcggctccgggccatggtatcccagcagttctacgaccgtgagaagaacgaccagatcctgttcggcatcctcagtcaggtcatggaggtccgctacggcgaaagctcccaccacatcccccgggtgcagcggatcacgggcatcctgctggaacggctctgccagaagactgaccgctacaacctgaccggagccgaccgccgcctcatcgtaacggcggccgccctccacgacatcggacggatggccattgacggccgcatcctcaacgcccccgacccgacgccggaacaaaaggccatcctccgcacccacaccattctgggtgcgcagatgctggaaaatctgtcccagtatcaggacgagccgctggtaaagttcgcgctccagatctgccgctggcatcatgagcgctgggacggcaacggcttccccgacggcctgaagggcgacagcatccccatcgcggcgcaggtggtctcactggccgatgcctacgacagcttggtcggcaagggggacaaacatctggccctcccgcaggcgcaggccatcgccgagctggaagccggaacgtatggtgcattcaacccgctgcttctggaatgcctgcgtgacgtaaaagaccgcctcgcagaggaggccgggatggatccccccgcccccccccagaaaaaagactaccctttgacgaaacttctcttggatgaggtataa

SEQ ID NO: 2583 - DNA, 1314 bp, Unknown
  Artificiall/Consensus sequence
cggctcctgccgtctgcggcaggaatggagtctcacatgatggacaaaaaaccgcacatcaagccctacatctacggaatgttggcgggctttggtgcgataagcctgagcatcctctttttcttcttcatctaccgcttcgacggcttcggcgacgccgtctctaccatgaccggcatcctgatgcccttcatctatggtgcggtcatcgcctacctgctcaagccggtgtgcaacaccatcgagagctttctacaccgcatcttcccccagaagatgcacggtctggccaatatgctggccatcgcggccaccctgctcttcggcattctggtggtctacgcgctggtgatgatggtggtgccgcaggtcatctccagcgtcacctccctctactacacggcccagaccagcatcacccgcttcatgcggtggatcaacacgcaggacgtctttctggacaatgcgaccctgatgggctacttcaacgacgcttacgatgccatcacgagcaatctggcctctctgcgcaccaccctgctgccctccctccagaacctgcagggcatcctgagcagcgtgggcgtgggcgtcataaacgtggtgatgtggttcaagaacctgctcatcggcctcatcgtcgcggtctacctgctggccagccgtaaaaaacttgtcaagcaggccaagatgattctttacagcatcttcaagccccgctgggcgcagctcattcaggaagaagtcctttacgcagaccggatgttcggcggcttcatcaacggcaagattctggactctgccatcattggcgtgctctgctactttgcctgcattgtcttcaagttccccagcgctctgctggtgtccgtcatcatcggcgtcaccaacgtcatccccttcttcggccccttcatcggtgcggtccccgccaccctgctcatcctcatccagagtcccatcaaggccctctggttcgtgctcttcgttctggtgctccagcagctggacggcaacgtcatcggcccgaagatcttgggcaacaccaccggactttccagcttctgggtgctcttctccatcctgctgtttggcgggctgtggggcttcgtgggcatgatcgtaggcgtgccgctgtttgcggtcatctacgacatcatcaagaagctggtgttccatggcctccgccgcaacggccagctcgggcaggtagaaacctaccatgaagagttcggcgacccggatgacccggctcccgcccctgccgaggcagagagcgaaaccgagatcgtcatcgactccggcgaagaataa

SEQ ID NO: 2584 - DNA, 1797 bp, Unknown
  Artificiall/Consensus sequence
atgaagaaaaaatggcccattctcattttttccgccctgctgacggctttcatcgtgctggccggcatctggggcaatgcacagttccagcagctgcccagcggcggcgtccttacggcccagcaggccgccaagggcatcgcgccggatggctggcggcaggaggctcccggccagtggcatttcaccttcaccgccggggaggatctctcgtctctcaccctctgcgtcaccaatacggcagcgccgctggaggccgaacggctgactgaccttgcccgctcgggcgagctgtacgcgctggatgttacacccggcaaaacggtggagctggtattcgcctgccgccgcagcccccagacatggctgatgtcctcggccttctccgaccgggccttccgtttccgcaccctgacccagctcatcaccctgacggcttttgtgacgatgggggtggtggtgctggccctctaccattataagcaccagccggagctggggtattttctgctctaccttgtcatcatgagcgcgtgggcgctgatggtctttttcttcccggccatccggagcggcccgcttcaactcgttctccgctctttcttcgccttcacggtgctggcctcggcgctgctggctgcggggttgctgggcatggagctgccccgctccgggcgggggcttctcgggctcatcgcgggctgtgccgttttcttcctgctgggcatgaacgactatcccccgctgcggttcgggatactggcgacaggtatgttcttctgcctctatctcctgatggccgctgtgaaggcaggctatgagggggccggactgatgctcctgccctgcgccgtcaccaccggtttccggatctgggcgctgctgcccggtctggacagccccttcttcgtggagtccgtccccttctacctgctgcgctgctcccgcctctacgacctgccctttgccatcggctgcatggtcttcgtctgccgccggttcgccctcctcttcgaccgcaccgagcagctggcccgggagctggacgcccgggtggccgagcggacgaaggagctgaccgccgagaccgatgcccgcaagagcatgatgctcaacatcttccacgacctgcgcagccccctgtttgcagtcagcaacgggctggaaacgctggaatctgcccccgaggccctgcctgcccttctgcccgccctgcgccagcgcgtcgagtttctgcggcggctgacggaagacctcttcctcgcggccaagctcgagcagaagcagctcctgctcaacgaggaccgcgctgcgctcaacgaagaagccgccgccgtctgcgcggcctgtcagagcgaggccgaccaaaagggtgttgcgctctgcgtcagcgccgacgttctcctgcccgtctggggcgacagcgtgcggctgcagcagatcctccagaatctcgtgaccaacgccatccactacacccccgccgggggcagcatccatgtggtctgccgcgccgagggcgggacggcctgcgtcagcgtgcaggacaccggctgcggcatcgcaccggaagatcagggggccgtcttcgaccggtatttccacacctctgccgacaaaaagcacgactccaccggcctcggcctaaccatcgcgcaggagctggcccgcctccatcacggcgagatcaccctgcaaagcgaagtcggcaggggcagcatcttcacgctgaggctgccgctcttgaatatcgaagagtatagcagtttgcgcttttatcgcaagacaagaaattag

SEQ ID NO: 2585 - DNA, 2652 bp, Unknown
  Artificiall/Consensus sequence
atggcaaaggatgaagagcggaaggaactgacgcaggaagagatcgacgcccgcgacgagaaattccgtaccttttttacgaccagtgtggcgcaggtcccggaggagatgacccgacgggacgatggaccggacgaaaagcctaataagggcctgttcggtcggctgttccgccgcgagaaaacggagctgcaggccgacggcgcagcggaagagagcagcaccggcgagatccggctgggcggtgaggagcaggagaacccctccgagctggagctggtcctgaagctggaagaggagacagagccttcgaagcctgagacgccggagccggcgggagcggcgagtgcgccccagccggaaccggagaagccccaagtgtcccagcccaaagcgccagagacgcctgccccccagccggacaaaaagccaacggaaaaacagtctgcctcccggaaaaaggccgtccagtacggcccgcgcaccccgcaggagcagtacgaggaccgggagatgcaggcgctgaaggccatgctcttcggcccgaagcctcagccggaggccgaaaagccggagaagagcgtcccggaagccccggctgtccagaagccgggaccggaaaaagagccggatgccaagccggagaggcctgctgcgccgctgcccgagctggtatttgcggaggacaagacggcgaagcctcatgcagccccggccatgcacttcttcggcaagggggaggacgaggaaacgctctctgcccccacccgcacgacgccgcccagcagcgacgacagcatgagcctgccgctcattgacctgaacgacgacgggcctgctcccgcagagacgccggacgccgaagcgcctgcgcagcctgccgcagaggaagccgcccccgcagaagaggcgaccaccgaggcggaaaagacccccgaagcacctgagcagatgggcgaccggctgcgccggatgagcgcggcccttaccctgcgctgtgcgctgggtggcatcctcgcgctggtgctgctccacttcggccttgccgcagagggccttgtcggcccgctggccgggctggattccgtgactgccccggcggcgttctacgccgccaacctgctcttctatgccttggcactggccgtgggctggcccgtcctgcgggacggcctgcagggcctgcggggccgtcccagcatggagacgatgcccgcgctggccgcttgtgccgccctgctgcaggccgctgtggccctgctgaacgccaagagctatcagccgtccagcttcaccctcctgtccggcatcgcggcgctgggactcttccttgcgctgctgggcgaccgggtgctgctggcctcggtgcagggcggatttgcgctggcgcaggctgcaccggagcggcgcggcgcgttccgcgccaaggacaaggagcttgtccgggtgctggctaagaatatggaagaaaaagacccgtgggtgctgctcagccgccccaccgagtgggacgacgcgatggtggaacagggctttggcccccgtgcctgtgagcgccgcgcccgcaaaacgaactatatcctgctgggcgtggcccttctggccggattcgtattcctcgtcatgggcggcggcgtcaacggcagcgcggcggccctgaccgccgtgctctgcatggggtcgcccctgtcctccaccctcatcgccggccttgcgtctctgcggctgcagcagaccgcagctgcctcgggcgctgtggtgcccggctggtcggccatcgaggagctgggcggtgtggacacggtgcaggccgacgccgacgagctgttcacgccggacagcgccctgctggaggacatccgcatcttcaagggcggccgcatcgaccgggccatcctctattcggccagcgtcctcagccagtgctgcaataccctgagcggcctgttccgccagatcatcgaggaccgcaccgacatcctctaccccgtcaaggatctggaagtccatcggggcctcggcttctccgcgtggtgcgacaacaaccgcatcctcatcggctcccgcgcatacatggaaaaggaagatgtgcccctgcccgacgaggagtatgaggccaagcactcgaaaaacggcgagctgcagatcctgtatctggccgtctccggcagtctgcacgccatgttcgtgctccggtatgtgggcgggcggaatgcggcccgtgggctggaacagctccagaaggagaacatccagctgctggtgtcctgtcaggaccccagcctgacggcacggcagatcaccgacgcctaccacctgcccgaggggatggtcgtcctgctggatcaggagcagtgtgccgcgctggatgccgccaccgcccagaacaccggctctgaggactgctgcatcctctgcaccaagggctttgccagcctgaccggcggcctgcgggccgcagagcaggcccagaacgccgagacgactgccaccacggtacagctggtgtcggtgtggttctcggtggccattgccgtcctgctgacctatgcgggcagcgtggggatgctgagcgtggccgcagtgctgatgtatcaggccgcgtggagcgccctcagcatcgccgtctgtgccctcaagcagcacagttga

SEQ ID NO: 2586 - DNA, 1569 bp, Unknown
  Artificiall/Consensus sequence
atgaaacgacgtgatttctgcaaagcgctggcttgcagtgccgctcttgcgcccgggctgactctgccccgggccgaggcagccgcgaagaaccagacggtgggccgcgcggtgccgtcgggaaaatacagcctgtcgttccgcagcgagctgagccagatggacattgagcacgaatattactacagcgacagcttttttgcgcactcgtccctccagtatgaccaccagctggcgctggccacgctgggcatggtgggcgcggcattcaatacatgggccagcgaggcgaaatactgggccaacggggatgtgggccgcgagaacagcctcgacgcggcctatacgaagctgggctacagcgatgcgaagtatcgttactacgacatcgacgtgggcaaggccggtgacttcgtgggctggtccaccgcccgcaagaccatcaccctgaatggcaggcggaccaccatcgtggcgctcatcctgcggggcggcggctatggcggcgagtgggtgagcaacctgcacaccggtgcaggccatgcccacagcggcttcatcatcccagtgaacgaggtgttcaccgatttgaaaaattatctggccgcagcccagaaggcgggtggactgggccttgtcaagctctggatgggcggctacagccggggcgctgcggtggcgaatcttctcgccgcccgcctcaacaaagagctgcccggattggcgcgggaggacgttttcgtctacacctttgccacgccggtggccctcggcccgcaggactaccccaacctgcagcaggactacgacaacaaccacaacgccgacggcaccctgaaggagagctggggcgagagcaatatcttcaacatcgtctccagcggcgacatcgtgccctgcctgatgcccgaggaatggggctaccaccggaacggcaacgaccgcttcctcccctccacccggaacgaagaggagctgaacgacctcaacgagatgggcaggaacgatttcggccccgtgccgctggatttcagctggcttgccaccaacgaagagacccacgagcttatgctcaagatggaggaatatttcatctcccgggagaactaccacgagaactacgaggcggccctgatggacatggtccagtgcaccttcatccgctcggaggaagaggtgacggagaacaagatcctcgacgacggcgaggtcatccagcgtctgcgcaccctcacccacctgaagaacatggactactggaagatctcccacgccgtctgggcggcgtccaccatgagtcgtgccgtcctcaagcgggtcgatacgggcagcatccccatccgtgcccagcagatcgtggtgccggtgctggccgtgggcctctgctacggccttgagagcgaggcggtgagcctcattgcaaagtacatcctgatgttcgtgtcgatgcggagcgcccccgacaatgcgatccgtgcggcgttctgccaccacttcgagaactacaccgccctgatggagtattacgccccctcggagcactgcatggaagcaacgacccgcacctga

SEQ ID NO: 2587 - DNA, 1623 bp, Unknown
  Artificiall/Consensus sequence
atgtacagccgttataccaccctgcagcgggcacagctcgccaagcaggaatatcttgatacacaggacgtctttctcgccgtctacgcaccggggcggagggcctcgctggaagcctccctgcgcgaccagctccaccgcaagttcctgctggcagaggacctttccagcgggagtctgggcagcgcccgcggcgtgctgctggcgaaagaagacctgagcctgatgcccacggccctgtcctgctttgcggatgcgctgcgcagcggcgcagactacgtcaccagtgacgccgtcttcggctatgcaggtgccactgccctctaccacagccccagctttgcggcctgcccgggctgcgccctcgtctcccgggagctgctgctgcgctgtctggccgaggcccatgaccccgggaaccccgtcgagctgctgacgctggcggcaaagctcagccggaaccacgtctgtctcccgctggcgctggcccactacgagcgggacatctgtgccgaggatgtctggtcgatgaaggggaagcgggtgttcatcatgagccacctgctggacatgaccggcgcccccatcgtgctggtcagcgctgtgccggtgctgcgcagcatgggctacgaggtggtcgtcctcggcccggaggacagcggctcgatgccgctcttcctcgaagccggggctgtcgtcatcacccggcgcggctgcgtccagtctcccctgctgtgggggctggccctctgcgccgacttcgtcctcgccaacactgtcgtcgaggcccgggctgtccgtgccttgagcggggcacgggtgccggtgctctggtggctccacgacgccttcgcgggctacccccatatcgcccaccagatccccaaagagctgggagagaacatccgggtctattccgtcggcagccacgccgccaacgccatgcactcggtgcggccggagttcaacatccggcctctcatctacggcctgccggactatgcctccgagaaattcgcccactatgacctgagctatgcgggcgggcgtccccttttcgccaccgtcggctccttcgagaaccggaaggggcaggacatcttctgcaaggccatccggctgctgccgccggagacgatgaaaaaagcctccttcctctttgtgggcaaagccgccgagccggagatgatggacgccgtgcgcagcctgacggcagactgccccgacaacgtcttctacgtcaagcggttgacccgggacgagatcaagagcctgatggctcagtgcacctgcctcgtctgcgcctcccgcgacgaccccatgcccaccttcgtcaccgagggcctcatcttcggcaagcccgccatcgtgtcggagcacaccggcaccgccggactcatcaccgagggggtggacggcttcgtctacgaggacgacgaccccgaaaagctggcggagcgtctggcatgggccatcgaccacccggaaaaactggccgccatgcggcaggcctgccgcgacctgtatgaacgccactactcgaagcaggcctttgccgacggcctgaagcaggcggtccgggagcttaccggcgaatccactttatcactctgccaaaattga

SEQ ID NO: 2588 - DNA, 1701 bp, Unknown
  Artificiall/Consensus sequence
atggactatcattcccccgaccgcacctacaaaaagagccgcttccggcgggaactggagcggagcgtttcccgcaggctggtcacgagcctgcttctggggtgccttctgttcctcgtggccatcgccgccgtgaacaccctgaaccagaacgcccggcgggaagaccatctcgcgggcgtcgctgccaccttcaatgaggtgtacaacgacacggcggcgttcctgctggacacagaccacaccgagctgttcctctccgaccggcggaaggatcaggacaatctgcgctatctcatcagccagtacaacgtctcggcccttgtggagctccagctcatcctgaccgactccaagggagaggtgcggttcacgaccttctcagagggggagatgaacctgcaccggcaggagttcaaccgcatcgcggaggaaaacgcctgccacctcatgcgggccgtctataccacggtctaccacttccgggccaacagctcggaatacgtcatgatacaccccctctaccgggacggcgaatatcagggtgcggcggcggtctatctgaacgagaacgactggacgaagctgttcagccgataccagtacgacgccatcctcaccaagcccaacggcgatgtcatcgcctgctcgaacgcctccttcctctcccagaagaacgccaacaaataccgccccgccgacgcggcgcggtatgtgaaggtggatgggagccgctatctgcgcagcagccgctcgctggaaaacggcacggtgctggcttattccttcatctactcgcccccgaactacgattatcttctggtggggctgttcctgattttgatgctgggcctgagctggtcggcgatgttcgtccgcatcatgcacgtcatgaccgagcagatggtgaagtcggtggacaccctcgtgcaggagatccggttcatccggaaggaagaccccgaccatatcattgagatcgacaccggcgacgagatcgaagagatcgcccatcaggtcaacaagatggtgcgcagcattcaggagctgagccagcggaacatggacctcgtcgaggtgaacagccggatggagatgcagaacctgcaggcccagatcaacccccactttatctataacacactggacaacatccgttatctcatcccggcggacccccagcgcgcccagcagctcatcgggcggttcatcggcatcctgcgctacagcatcaacaacaccaagcataacgtcaccgtccgggaagacctgaagtatctgcaggactatctcgtcatccagtccacccgcttcggcgcgaacttctcctacgagatggacatcgacgacgcctgcatggagttcatcatcccgaagctgcttttgcagcctctgctggagaacagcatcaaatacggcttccagaagaagccccgcatccacgtcaggacgcggggctggctggaggaggacgcgctctatttcacggtagaggacaacggcggcggggtggacgcagcgacgctggaacagctgcggggcatcctgcgctcagaggaagtgaacattgaacacaacggcctgcaaaacatcaaccgccgcatctggctgggctacggcggcgacagcggcctgaccattgacagcgccgagggcgagggcttcacggtgaagctcaagctccggcggggagggaggtag

SEQ ID NO: 2589 - DNA, 2406 bp, Unknown
  Artificiall/Consensus sequence
atggacgatctgaatcatcaggccgggagcgcccggcttctcaatatgccggggcggcgggatcagatgctccgcacgatgctgctctgcgcgctgacggcggcagtgttcttcctgccgttctatctcatagatggcggctttttccactacgccggcgatttcaacagccagcagatcagcttttaccgttacatgaacggcttcatcaaggggggcggctaccccgacggcatggccggtgcggcccggaacaccttctcgtgggccaccgacctcggcagcggtgcgatgaacgcctactccttctatctgtacggctctcccttcttctggctgtcgctcatcttcccccagaactggctgccctacctcatggtgcccctgctcatcctcaagttcgcggtggcgggcggcggcgcataccgctacctctgccgctacgtccgccgcaccgactatgcgatgctgggcgcctgcctgtatgcattctcgggcttcagcgtctacaatgtctttttcaaccactttgtggatgtggtggccctcttcccgtggatgctctgggcgctggatgagacgctctatgagcaggaaaagcactatgggcttttcgcgttctgggtgggggtcaacctgctcaacaactatttcttcttcatcgggcaggtcatcttccttgtcatctactttatctgtaagctgaccaccagagatttcccgatgaatctccggctctttgcccggctggcgttcgagagcctgctgggcgcggcgctgggcttcgtcctgctctggcctgccgtgctgagtctgctgcagaacccgcgcaccatcgatctctcgtcgggatggggcttcctgacctactcgaaggtgcagcagtatctggccatcctgctgagctggatcctgccgcccgactcgccctatatcacctccatctggtcggagggcatcatcaaatggacgagtatgtccgcctacctgcccctgtgcagtctggcaggcgcgatggcctactggcgggcacggcagggtgacagcaaaaagcgcatcgtcgctgtctgtgccgtctttgcgctggtgccggtgctcaacagcgccttctatgccctcaattccagctactacgcccgctggtactatatgccggtgcttatcctctgcgccatgacggcctgtgggctggaaagccccgacatcaccgccgacgagctggacgctccggcgcggggcatcggctggctgatgctggcgacgctggcgtttgccgtggtgccggtgcaggacagcagcaccaaagagtggtcgctgggcgttctgcagaatcccggccagtatttcgtcgttctgggctttggtctggggggactggtgctctaccacttcatctgccgccgctggcggggcagccgggcctttgcccgccggatgacggcggcggtgctgacctttgcctgcctgttcagcatggtgcacatcggcatcggcaagttcggccagtggcacacggacagcgaccttgtggagcagtacacctcggccctccagcttaaagacgacctgccggagggcgactggcgtgtggacacttatgagacccacgacaacctcggcctctggctcgacaagagctgcctgcaatacttcggcagtacggccgcgcccagcatcctcagcttctacccggcgctgggcgtcaagcgggatgtccgcagtgagccagagatctcgaattacgccctgcggggcctgctgagcgtgaaatacctcatcactacccccgaaaagcaggaggactttctcgccgctgccgatgaagggtgggactactacgacacccgggacggcttcatgctctacgagaacgaaaattacgtccccatgggcttcacctacgactactacatcaccgaagaggagtacgaagctacggtgaaaaacacccgttcgaaccttctgatgcgtgcgctggtgctcagcgaggaggatgccgcagtctatggccagtatctcaaaaagctgcccgaggagaagcgaaacgacctgtggtatgacacctatgtctccgactgtgccgaccgccgggcctctgcgtgcagggtgttccagatgaccaactccggcttccatgcggagatcgacctcggaaaggaggacctcgtcttcttctccgtcccctacgacgacggcttcacggcctacgtcaacggtcaggagaccgacatcctccgggtggatgaggggctgatggcggttctggccccggcgggggagaacaccatcgatttcgtctatcaggccgacggcttctctctggccagcaaggtctcgctggccgggctggcggtgtttgtggtatacacggagtattttgtctggaagaaaaagaaacgctgttga

SEQ ID NO: 2590 - DNA, 1152 bp, Unknown
  Artificiall/Consensus sequence
atggagtatcggaactggaaccaaaaagacggcaccggacggagcatctccacctccctgctgggatatggatgtatgcgctttcccaccctgccggacggcagcatcgacgaggtgcgggccgaaaagctgctgaacacagcccgggaggcgggcgtcaactattttgacaccgccttcccctaccacggcggcgcaagtgagcctttcgtgggccgcgtcatcgcaaaatggccccgggagagcttctacctcgccaccaagctgcctgtctggaactgcaagaccctcgacgaggccaaggccatcttcgagcagcaattccagcggctgggcgtggactacatcgacttctacctgctgcattccctgcacaaggcccgctatgacgcggccaagaagatgggcatcgtggattggctctgggagcagaaagccgccgggcgcatccgcagcttcggcttctcctgccacgacaacgcagcaggcttcgagcacatcctgcgggaccagccgtgggacttctgccagctgcaatacaactatcttgacaccgacgaccgggctgaagagatcgcaggcgaccggggctacgccctcaccgaagagcggaatgtccccctcatcatcatggaacccatcaagggcggcacgctggcccagctcccgccggatgccgctgcgccgctgcgcgcactggaccccgccgccagcgccgcctcgtgggcgctgcgctgggtggccagccataaaaatgtgaaggtcgtcctctccggcatgagtgcagaggaccagctgggcgacaacctctccaccttcggacagttccggcccgtgaccgacgccgagaacgccgccatccgccagactgccgacatcctgcgcagccacatcagggtcggctgcaccggctgccgctactgtatgccctgcccgatgggggtggacatcccggacaatttcagcatctggaacaaactggggatgttcggccagaaggacgccatccgtcagcagtggacggcccacttccccgacgccgaaaaggctagtcactgtgtccgctgcggcaaatgcgaggccgtctgtccccagcacctgcccatccgggactccctcgcaaagcttcagactgagctggacagcttataa

SEQ ID NO: 2591 - DNA, 1986 bp, Unknown
  Artificiall/Consensus sequence
gtgcgccatccgggcggtttttcagaagatcgccctgcctgcaaaaatgacttctgtgttgaaatcatccggaatttgaaatgtgaggaggacggtcactttatgcatccttcactgcttcagaatatttcacagccaagtgacctgaagcgcttgaacagtgcgcagatccagcagctctgcggggaaattcgtcaatttctgctggacagcgtatccaaaacgggcggacatcttgcttccaacctcggcgcagtcgagctgacggtcgcgctccatcgcatctttgagaccccccgggatgcgttcgttttcgatgtgggccatcagtgctacacccacaaactgctgaccggacggtacaagcgcttcggcaccctgcggcagctggacggcctttcgggttttccaaacccgaatgagagcgttcacgatgcttttatcgccgggcacggcaacaccgccctctcggtcgccatcggcatcgcatgggccaaaaagctcaagggcgagccgggccatgtggtggccatcatcggcgatggtgcctttaccggcggcatggtctacgagggaatgaacaacatcggcaagctggacaatctgatggtcattctcaatgacaacaagatgtccatctcccacaatgtcggcgcactggcaggggatctgagccgtctgcgcaccacgacccgttatttcacagcaaaggagaatgtcaacagctttttgagcggagtgccgctcgtcggtgcgcccatcaagactgccctgcaaaacagcaaaaaagtggtgcgtcgggccatgtatcactccacgatcttcgaggatatggggttccattatttcggcctcatcgacggccacaacgagccggagttggagcgcatcctgcagacggtctgtgcccagcccgggccgacgctgctccatgttgtgacaaaaaagggcaagggctacgccccggcggagtcgaatcccggcaactatcatggcgtctcgaagttcgatctggcaggcatccccgacccggagatcgccccggcggagtcgttctcgaatgcctttggccgtgcgctcagtgaggccggagatgcggacgataccctctgtgccatcacagcagcaatgaaatatggcactggtctgcaatttttcagccacgcccacccggagcgcttctttgacgtcgggatggcggagcagcacgccgtgaccttcgccgccggccttgccagcaaggggatgctgccggtggtctgcatctattcgaccttcctgcagcgtagctatgaccagatcatccacgatgtcagcctgctgcgggagaatgttgtctttgccgttgaccgcgcaggttttgtgcccggcgatggggagacccatcagggcatctacgacccggccttcctcagtcaggttggaatgcccatctactcgccctcgaactatgaggagctgcggtactggctggccatcctgctgcggcatgagatgcaggggcctcgggccatccgctacccccgcggcggcgagagcaaggtcttggccggatacggctgcacgggcagggagtacgacaagctcgtctctctaccgggtgcaaagactgcgctggtgagctatgcggatgaggtggaggatgcccttgccgccgcagagctgctggcaaaagagggtgtcccctgcgatgtgtataagctggtccgcatctttccgttcgggaaagggctggtgcaggagctttcggcctactccatcgtcctgatggcagaagagtgcgcagcctgcggcggcatcggagaacatctggcccgcgctctgcaggatgcaggctggtgcggccggtacatccaccgcgcggtgagggagctgaacctgccccacgcgacggtgccccagatcaagcaggcgaccgggctggatgcggggcatctggccgaggccgtgcaggcggcagacccgaaaggagagaaaacactttga

SEQ ID NO: 2592 - DNA, 1893 bp, Unknown
  Artificiall/Consensus sequence
atgctgattcatttggaaaaactcggaaagagctttggcgaaaaggtcgtcctgcacgacgtgagcgccagtgtagaaaaggaagaccgcatcggcatcgtgggtcagaacggcgcgggcaagacgacgctcctcaagatcctgaccggcatttacaccgactatgacggggaattcagtgtgacccacggcgtgacgctgggctatctggaacagaacgcaaagcttgacacgacacttgatatttacggggagatgcgctcttcctttgcccctgtgctggacgcgatggcccagatgcagattttggaaaagaagatggcggccgcgccaaatgacccttcgctgctggaaaagcacgatgcgctgcaaaacatcatcgacgcggccgacggctacaacatggacgtcaacatcaaaaaggtgctgtccggcatgggctttgcgcaggatacatggggcaagaacgtgggtgttctgtccggcggtgagctgacccgtctgcgtctggcaaagctcctgctggaaaagccagatgtccttattctggacgagccgaccaaccacttggattttgccacgatggaatggctggaaagctacctcaagggctactccggtgcggtccttgtggtcagccatgaccgctatttcctcgacaatgtctgtaccaagatctgggaggtctccttccagaccatgaccacctataagggcaacttttcggcctacctgccccaaaaggaagccgctgacgccctgcgccagaagcagcacgacgccgatgtggcgctggctgaaaagctgcaggactacatcgaccgcaacctcgtccgcgcctccaccaccaagatggcccagagccgccgcaaacagctggagaagctggagatcacagaggctccgcaggacgagacgaatcagctcaaattccgcttcgaatacgacgtagaaccgtggaatgagctggtgctgctcaagaacctgaccatcaaaatcggcgaccggactctgctggaaccctttacctatacggtctgccgcggccagcggctcattatcgccggacccaatggcgcgggcaagtccaccctgatgcaagtgctggacggcaagcgccgtccctccggcggtatggtgcgtctggggacgggcgcacggcccagcatctttgcccagcagcagaaccgcatcggcgcaggccgcgtcatcgacgtcatctggaacaaatacccccgaatgaccgaattggaagtccgcagccatctggcgaagctgggcttccggggggagacggtcttcaagccctgcgaagccctgtccggcggcgagctggcccgtctgcgcttcgcggagatcgtgctggaacggccgaatctgcttttcctcgacgagccgaccaaccacttggacatctacacccgcgaaaatctgaccgaggcgctgatggcctacaccggcacgctgctcctcgtcacccatgaccgtcatctgatgaacagtctggcctgccctatcctctatcttgaggacggcaaagcggttatttatcccagctacgatgccctgatgggccgcgccgctcctgcccctgtggcagagaagagcggcgagcctgctaaggcaggctacggcaaggaacagcgccgccgccgggcagagctgcgtgccaagatcaaagcctgcgaggacgagatggaggcctgcggcgcccgggaagtggagctggaaaacgagatcaactcaccggaggtctacaacgacccgcagctcctgcgggaaaaaagcgacgagctgagcgacctgcgcttccatcaggacgagctttttgccgcgtgggaagctgctgtcgaggagcaggagcaatacgagcagtccgcaggcgaagaataa

SEQ ID NO: 2593 - DNA, 2784 bp, Unknown
  Artificiall/Consensus sequence
ggcagggcagtccgctttgcgcaggcgcatttcttttttgcagaaaaaacgatttctgaaccaccgggaggggcagaaaaggatatgtcgattttagtgcatgattcaaacaaatcggcctgccgtgcggcggcagccgccttgcagcagggctgccgggccgcgctggtgcgtccggcgggcaccggcaagggccgcatcgtgtgggagatgctggcagaacagcctgacacccgcgtcctctgggtggcctcctgcgccgcgcggctcgaactgcgccgcggactggcgaagaagctgggcaaaacgctggacggcagcgtccggctgatggactgtgagcagctggctgcacagagcgcgctgggctgggtggcgctggcagagttccggcccggtctgttggtgctggacggctggcgggagatgagcgcacgggactggacggattgcgtccagctcctgttccgcctctgtccggaggccaaggtgctggcgctggccgagccggacgccccgggcgagagctgccgcgctgccgaagagctgctgggcgatgctgtggtggagccgctgacgctgggcggggcattggccgatgggctgctgcccatgccgacctcctacacggcgctgctctggccgcaggaggccgcaatggcccgtctccgcgccgaggtgaagaacctccgcgtgcccggcacgcccgaccccaacgccgaaaaatatcaggcactgagccttgctgtggagcagctgccctccgtggaagtgctgctggcgcggtggctccccgatgccgccgggcggtatctcgtcctctgcgaggatgcccagacggcggcgcagatggcccagcaggccgaagcgctgtttggtgcgggggtgcatacctgctgcaccgatgcgctttccagcgatgcagagcccttcctgaccgacgaggccgacgcgctgcggctgctggtctgcgtcaacagtcctgctgtcgagacgccgctgaccggcatttcaggcgttgtcctcgtccgccgcaccgctgaggcacccgcctatcggcagatgctggcccgcgccctcgcggcctgcggcagtgtgccggtggcagagctgagtgctaccttcgaaggactgacctgcgtgccgcagctccggaaggagtgcggcgagaagccattcccgctgtctgagccgctgtccgcctgccgccgagcctaccggcagcttcgccgggcactggacgccgaatgggagcgctattttgccgctgcgaaacagatggccgcaaagaagctgccgctggatgtgccccgcgcctacacctttgagggagtggccgtgggccgctggctggaaaaccagcgcctcgtgcgggccggaaagaagaatggccgcctcacggccgagcaggtcgcccggctggacaagatcggcatgaactggaaaaagcgccttgagctggcgtgggagaacggctgggcctcggcccggcggtaccgcgacagccacgccgaccttctggtgccggtccactataaagataagaacggctttgcgctgggcgagtggatcgtctacaaccgccagcgctatcagggtggcagcctttcagatgaccgcatcgagcggctggaatcgctgggcatggtgtgggacaccggcagcatcctctgggaaaagaactatgctgctgccgtccagtaccatctcgagcacgatgacctcgagatccccgtcaagtacgtcacgccggacggcatggcgctgggcgtctggctgggcagccagcgggccgcctataaggaaggaaccctgactgccgcccagatcgaaaagctggaagccctcagcgtggactgggcgaaccggaacgaccgcaagtggcagactgcctacgaggccgccgtgaaatattacagcgcccatggcaacatcgacgtgcccaccgagtacattgacgaggacggcatcctgctgggcaagtgggtgtcccgccagcggtatgcatggcagaaccccgagcgcagcagtgcccgggtcacgccggagcggaaagccctgctggatgagctgggcatgatctgggaaaagaccgactcgtggcagcaccgctacgagctggcggcggcatacaaaaaagagcacggcagtctggccgtcccggcgcagtaccggacggaggacggcatctggctgggcagctggctctcccgccagaagctgatgctgcgggagggcaaaaagctctccgcggagcgctgcgccgccctcagggagctgtttcagggcgagaatacccgccgccttacggccactgtgccgcctgcgtgcagcgtgcgggagcagaactggctggacaactatcaaagcgccaagcgctatgccgaaaagaagggcacccttctcgtgcccgccggatatgtggacgagagcggcttccggctgggcgtctggatctcgaaccttcgcgctgcccgcaaggcccggcccgagtcctttcaggtcacgccggagcacatcgccatgctggacgccatcgggatgcagtgggacgcccgggaggccaaatgggacggggcgttccgccgcgccgaggaataccgcgccgcccacggcgaccttctggtgccggtgaactacaagaccggcgacggcttctgcctcggcgactggatccgccggatgcgggagagctatgctgccgccgatgaccggctgacagccgcccacgtccagaagcttgaggcgctggggatggtctggacgatgccgcaggagagctga

SEQ ID NO: 2594 - DNA, 2301 bp, Unknown
  Artificiall/Consensus sequence
atggtctgcagtcgctgtcagaaacgtccggccatcatcttcgtccagcggatggagaacggccagatgaaaaatgaaggcttttgcctgcactgtgcccgtgaactgcacatcaagcccgtcgaggacctgatgaagcagttcgggatgtccgacgaggacatggacaacatggaaaaccggatggagagcatgatggacgagatgggagacgcgaatcccctctccctcatgatgaatatgggccagccgatggagggcggggagagcgagggagatgacgacctcgtgcccggctccagcgcgaccttcccgctgggcgtcaaggcggagggcgaagccggaaacggcaaaaaggcccagaaaaacggcaagaagccgccccgccgcaaattcctcgatacctattgtgagaatctgacccgcaaggcccgggagggcaggctggacgacatcgtgggccgcgaccgcgaaatttaccgcacgattcagattctgagccgccgccagaagaacaacccctgcctcatcggcgaggcgggcgtcggcaagacggccatcgctgagggcatcgcggagcggatcgccaagggcgatgtccccgtgggcctgaaggacaaggaaattttcctgctggatctgaccagcctcgtggccggcacccagttccggggccagttcgaacagcgggtcaagggcctgctcagtgaggtcaaggccgcgggcaacattatcctctttattgatgaaatccataccatcacctcggcgggtgagagcgagggcgcgatgaacgcgggcaacatcctcaagcctgccctgtccagaggcgaaattcaggtcatcggcgccaccaccttcaacgagtaccgcaagtatatcgagaaggatcaggcccttgagcgccgcttccagcccgtccgggtggaggaacccagcgtggccgatacgctggccgtcatgaacggcatcaagaagtattacgaggagcaccaccatgtgcaggtggaggcggatgtcctctcggccatcgtcaccctcagtgagcggtacatcaccgaccgctacctccccgataaggccatcgacctgctggacgaggcctgcgcctgctgcaaccttgcccacccggtcatctcggaatacctcgagatgcagaaggagctggacggcctgaagcaggaggaggcggagatggagtctgccgacgtcaacgaggccatcgactacgagcaggtggcccagcggaagacccgtatcgcaaagctggaagctgagctgcccgcaaagcaggccgcagccagcgagatcagggtcacgatggatgatgtggccaaggtcatcgagctgtggacgggcatcccggcagtaaaaattcaggagacggagttcgcaaagctggccgggctggaagcggagctgaaaaagaagatcatcggtcaggacgaggccgtccatctcgtggcacaggccgtcaagcggagccgtgccgacctgtcgggacgccgccgcccggccagcttcatcttcgtcggccccaccggcgtcggcaagaccgagctggtcaagcagctggcaaaccagctctttgacggccctgaccccctcatccgcctcgatatgagcgagtatatggagaagtatgcggtgtcccgcatgatcggctcgcctccgggctatgtgggctacgaggaggctggtcagctcaccgaaaaggtgcgccgccgcccctacagcgtcgtcctcttcgatgagatcgaaaaggcccaccccgacgtcatgaacatcctgctccagattctggacgagggcaagatcaacgatgcacagggccggacggtggatttctccaacacggtcatctgcatgacctccaacgccggaagcggcgacaagagcacctccggactcggcttcaacaagagcgaggagcagctgagcgaggaaaagacccgcaaagccctgagccagttcctgcggcccgagttccttggccgcgtggatgaggtcatcgccttcaagcccctgagccagcagacgctggagggcatcgcggccctcatgctggacgagtacaagcccagcatggaatcgaagggcatcgcctaccgctacaccccagcggcgctgtccgccctcgtggccaagagtcagggcggcaagttcggtgcccgcgacctccgccgcgtcatccgcaaggcggtggaagaccctgccgccgagcgcatcatcgacggcactctgaaggcaggcgggagcctgaccgtggacgccgagaacggcgaagtcatcctgaagtaa

SEQ ID NO: 2595 - DNA, 1374 bp, Unknown
  Artificiall/Consensus sequence
atgacccgatcccctgcaaaaaaatcgtttttcagccagagcgtggacctgatgaacggccccatcttccagagcctcgtcatcttcatgctccccattctggtgtcgagcctcttccagcagctctacaacaccgtggacaccatgatcgtgggcaatgtgctgggtgataccgcccttgctgccatcggggcctgcggggccatctacgagcttctggtcggcttcggcatcggcatcggcaacggccttgccatcgtcgcagcgcgctcctacggggccggagacgacgagcagctcaagcagaccgttgcaggctccatcgtcatcggactcatcgcgtcggcggtcattacgctggcgggcgcgctgggcctgcacccgctgttggagctgctggacaccccggtcgagatctttgaggacgcctaccgctatatcatcatcatcgactacggcgtcttcatcatgttcgcttacaacctctgtgccggtctgctgcgagccatcggcaacagcttcatgccgctggtcttcctcatcctctcgtcggtgctcaatgtcatcctcgacctctggttcatcgccgtgctgggcatgggggtagccggtgcgggcgtggccacggtcatctcgcagggcgtgtcggtggtgctctgcatcctgtacgtcttccgcagtgcccggctgctcctgcctgagaaaaagcacttccatgtaggcagccgcctctactgggagctgttcagccagagcatctcgatgggccttatgagcagcatcgtctcggcaggctcggtggtgctgcaatacggcatcaacgggctgggcacgctggtcatcgcgggccacaccgccgcccggaagctcttttccttcacggatatgcctctgacggcgatgtcctccgcctgctcgacgttcgtatcccagaactacggcgcgaaccaccccgaccgcgtccggcgcgggatgcgagacatcatcctctacagcatcgtggtggccgccgccatcacggtgctgatgagcgtgggcgcagaatggatggtccggctggtgtccggttcctctgagccggtggtgctggaaaacggcgcacggtatctgatctggaacgcccccttctacgccgtgctgggcgtcctgctggcgaaccggtatgcgctgcagagcatgggcgaaaaagtgctgcccctcctgtccagcgtcatcgaatttctgggcaagatcgtctttgtcatggtgttcatcccccgctttgcgtacaatgcagtcatcctctgtgagccggtcatctggtgcttcatgaccgccgagctgatgacggtctatctgcacaatccgttcgtctttccgaagaagaaaaaataa

SEQ ID NO: 2596 - DNA, 1287 bp, Unknown
  Artificiall/Consensus sequence
atggcgaccatccgaagaaaaaagtctgagccgtttgccatcgtccagaaagaccccggcccatggccgcaggtgctcatcaactggctggcgacgctggcggtcatcatcgtgttcgggctgatcatgctgttcagcgccagctacaccacgggctatctgcggatgggggacagcttctactacattaagtcccagatgttctgtctggggctggggctgggggcgatgctgctcttctcccgcatcgaccaccgcttcctgcgcaggctggtctggccgggctattttatctgcatcctcatgctcatcgcggtgctcttcagtgcgcccctgaacggctgccgccgctggctgcgtgtggccggtgtcacagttcaggtgtcggagatcgccaagttcgagatgatcctgctcacggcccatctggccgcgaaagcgccccatctggaaaagctcgacccctcctcgccccgccggatcccggtgcggaaatggctctaccagcgcatcgtgcgggagctggtcatcccgctgctgcccctcgtcccggtggtgggcctgctggtgctggagccgcatatgtcgggcatcgtcctgacgacggccatcgtgggcaccatcctcatgctgggcggcagcggcggcgtcatcacatgggcgtgtgccggcctcggcgcaagcctgctgcagacgctgctggggcatatcgactccatcccctacctgcagagccgcctcgacggctggacgcatgaccttgccaagatgaccgaccagaccctgcagagcctttacgccatcggctccggcggcgtgacgggcctcggcctcggcaacagcatcgaaaagcagctctggctccccgaaagcaccaacgacttcatcttcagcgtcgtctgcgaggagctgggcttcgtgggggctgtggtggtcatcctgctcttcgtcctcttcctcgtgcaggggctgtggatggcgttccacgccgagaaccgctactgctcgctggtgggcatcggcatcatggcccagatcgcgtggcaggtgttctgcaacatcgcggtcgtcaccaacaccctgcccaacaccggcatctccctgcccttcttttcttccggcggcaccagcctcatcctgctgctggccgagatgggcgtgatgatcaacatcggccggggcggcgagcgcgcccgcctcgagcgggaaaaccgccgcgccctgcgggagcagcaggaaaagaaaccggataacaccattgtactcagacccgatatgggcctctga

SEQ ID NO: 2597 - DNA, 1449 bp, Unknown
  Artificiall/Consensus sequence
atgatggaagaaaacaaggagcggaacatcgtctggaagccccagccgaggcagctggaatttatgcggcggcctgagccggaggcgctttacggcggcgcggcaggcggtggaaagagcgacgccctcgtcatcgaggcactgcggcaggtgcacatcccccactaccgggcgctcatcctccgcaagacctacccgcagctgtccgacctcgtggacaagagccagcgctactatctccgggctttcccggaggcgcagtacaacgccacgagtcatgtgtgggtcttccccagcggggcgaagatctatttcggctcgatgcagcacacgaaagaccggacgaactatcagggcaaggccttcgacttcatcggcttcgatgagctgacccacttcgagtgggaggagtacagctatatgatgagccgcaaccgtcccaccggccccggcacacgggtgtacctgcgggccaccacgaaccccggcggggtgggccacggctgggtcaaggcgaggttcatcactcctgccccgcccggaacccccattgaggaggagtgcacggtgcagatgccggacggtacggaaaagatgctccggcgggcgagggtgttcatcccatccagcgtctttgacaaccccgccctgctgaagaacgacccgggctatctggccagcctcgcagccatgccggaggcggaaaagcaggcgctgctctatggcagctgggacagcttttccgggcaggtgttcaccgagtggcggaacgacccgaagcattacgaggaccagcgctggactcatgtcatcgcgccctttgccatcccgaagcactggaaaatctaccgggggtatgacttcggctattcgaagccgttctcggtggggtggtacgcggcggacgaggaggggcggctctaccgcatcaaggagctttacggctgcacgggccgacccgacgagggaacgcacctcgacccggtggaacaggcccgacgcatccgggaggctgagcagaacgacccgatgctccgggggcgggtgatcacaggcattgccgacccggccatctttgaccagagccggggcgagagcgtcgcggatatgcaggagaaaagcccgaatttcctgcattggaggcccggtgaccacacccgtctggcgggcaagatgcagttccactaccggctgcatttcgacgaggagggcaggccgatgctgcaggtgttccatacctgcaaacacttcatccgcaccatcccgaacctcgtgtacgacgagagcaatgtggaggacatcgacacccggcaggaggatcatatctacgacgagtgccgctatgtgctgatggagaaccccatctcgccgccccggcagatcgccgagccgagggtgcgggatgacccgctggagctgcatgggagggcgagatttctgagggtgtga

SEQ ID NO: 2598 - DNA, 2634 bp, Unknown
  Artificiall/Consensus sequence
atggcaacagatctcgcacaacaattctgcgctttgcgtgatacctatatcgaaaagcagttcggacggctgaacgagatgcagcggcaggcggtgttcaccaccgacggcccgctcctcatcctcgcgggggcaggcagcggcaagaccactgtgctggtcaaccgcatcgccaacctcatccgcttcggctcggcccacggctcgaaatggacgccccgggaggtcacggaggaggacgtgaaggccctgcgcaccgccatcatgaccggcaccgacgccccggtgtggctggacgggatgctccgccagaacgccgtccgcagctggaacgtcatggccatcaccttcaccaacaaggccgccggagagctgaaagagcgcctgcgccggatgctgggcggggaagagggggacgaggtcttcgcctccaccttccactccgcctgcgtgcgcatcctccgccgctgggccgaggagatcggctaccctcgcagcttcaccatctacgacaccgacgacgcccagcgggtcatgaagacggtgtacaaggagctgagcgtggacgacaagttcttccccatcaagagcgccatcaaccagatgagccgctggaaagaccagctcatcagccccgaagaggccctgcgcacccccgcccgggacaccaagggcgccctcgcggccaaggtctacgccgcctacgagcggaagctcaaagaagctggtgctttcgatttcgacgacctcatctaccagacggtcatcctgctgtcggagcacgaggacgtccgcgagttctaccagaacaagtacaaatacctgctggtggacgagtatcaggacaccagcgtggcccagttccgcctcgtcagtctcctcaccggcccggagaagaacatctgcgtcgtgggcgacgacgaccagagcatctaccgcttccggggcgcgaccatcgaaaacatcctcaacttcgagcgcatctataagggcaccaagaccatccgcctcgagcagaactaccgctctacctccaatatcctgaacgccgccaactgcgtcatccagcacaacaccgagcggaagggcaagaccctctggaccaagaacggcgagggcgacaaggtgcaggtctacaccgccgagaacgagcaggatgaggccatgcacatcgccgacgtcatcggccagcacctcaaggcgggcggccatctggccgaccacgccatcctctaccggatgaacgcccagtcggcccccatcgaaagctatttcacccgcgccggcatcccccacaagatcgtgggcggccagcgcttcaacgaccgcaaggaggtcaaggacatccactcctatatgtccatcgtggccaacccccgggacgacatccgcctccgccgcatcatcaacgagcctgcgcgtaaaatcggcgcaacgactgtcgaggtcatcgccgacctcgcggcccagcagggcgtgagtatgctggacgtcatctcgcaggccgaccagtacgccaagctcagccgcgccatcgcgccgctgtataaattctgggacatctaccagaaattgcaggaatcgctggaaacaaagacgctggacgagttcgccgccgacgtcatcgagctgacgggctaccgcgccatgctggaggccgacgccgccaagggccatgaggacgccgccgaccgcctgcagaacctcggccagctggtcaacaacgtcaagagctactgcgaccagcacggggaggaggcctccctggagggctacttggaggacatcgccctcatcagcgacatcgacagctacaacgagagcgccgatcaggtggtgctcatgaccatccactccgccaagggcctcgagttcccctatgtattcctcattggcatggaagagggggtcttccccagtgaaatgagcaagtattccgaggccgacctcgaggaggagcgccgcttggcctatgtcggcatcacccgcgccaagaaggagctgtacatctccaacagcgtcacccggatgctctatggccgcacccagcgcaacgagccgagccgcttcctccgggagatcgagccggagtacctcgaggagacccgcagcccggtgctggagcagcgctcccgtctgggcggctggggcagcagctggggcagcgacaccgtcccgggcggcgcgtcgggctactccggcccctccggctgggggcgttcggcctccggtcgcggcggctacctcaatcaggaatacaacgccccttcgtccggaaaccgcggcttcggcgcggactatgcgggccggggcagtaccgcgtcgggctatggcagcagctccggcccgtccggcttcggcagcggctatggccgcccgacggcccccaaagcgccggtccggcccgcaggcggcggcgtaagcccggctcccgcgccccgtcctgcctccaccggccccaagcactacgagccgggcgacatcgtggagcacaaggtctttggccggggcgaggtgctgaaggtcaagcccgccgcaggcgaccagatcgtagagatccgcttcgagaaggtgggcgtgaagaagaccatggcaaactatgcgccccttgtgaagataacgacggaggaatga

SEQ ID NO: 2599 - DNA, 2562 bp, Unknown
  Artificiall/Consensus sequence
gtgcggcagcgcacgcttttctggtttctgcaggagaataccatgcaaaacaagccctccaaaaaccagcacaggaacgtctactaccgccttcgccgcagcgacccgcacgagcgcctcagcgcacggctgcggcgtttcagcttcggcgcggcggtattttttgtcatggcggctgcgggcatcgtgacctacagcctgtataagatccagatcgaacagggtgcgaccttccgccagtatgcggccgagcagcagctgctggacagcaccattcaggcgacgcggggcgagatctacgacgcctccggcattacgctggcctctaccagcgtagtatggaccatctgggccgaccccagctattccacggccctcttcaccagccagaccgccgaggagacgggcgaagtcctcaagacggtggacgagacgacgctggctgaggtgagccgtcagatcaccctgcggctgctctccggcgacggggagagccttgaccgcgtggacacctcttcggcggagtaccagacccagtaccagaccgtccacgacgcgctggcgaagaatacctcctcctatcaggtccttgccaccaaggtgaacaacgccgtcaagctctccatcgagaaatacgtcagcacctacaacaaagagcacaccaaggccaagacgctggaggacggcaccaccgtccggaagggccgcatctccgtctcctcgtccaagagcttccagcgggattacccctacggtgcgttcgccgcgtcggtgctgggcttctgcaacggcgatggcgagggtttctatgggctggaaaagtcctacgactccacccttgcgggcgtcaacggccgcaccatcacccgccgcaacgcctacggcaacgccatcgccgacgccaacgccaccacctatgccgccaaggacggctccaatctggtactgtcgctggacgtcaacgtgcaggaggtggtggagcgctacctcaacgaggctgtctacgccaacaacgtcgagaaccgcggtgcggccatcgtcatgaacgtcaagacgggtgccatccttgcaatggcctccaagcccgacttcgaccccaatgacccgctggatttcagcgcgaacctgacctatctgagcgagcaggttcaggccgagccggagatctataccatctacctcaaggacccggacgaccccaaaaaattcctgctggacgagaacggcaagaagatccccgacccggacccggactacaccggcacctaccgcgacatccagtggaagaacaaggccatcaccgagctgtactaccccggaagcgtctttaaggtcatcacggcggcgatgggggtggactcgggcaaggccacctattacaccaccctcaactgctccggtgcttacggcgtggcgaaggagacctaccactgcgccggaaagaagtctcacgggatccagaaccttgccgaggccctccgcaacagctgcaacatctacttcatccagctggggcagcggctcggctccagcgtcttttatgattacttcgacgccttcggcttcaccgagcgcaccggcgtggacctgcccaatgaaacgggcatgatgaagtattacaccaagaaccagctgggagaggtccagcttgcgtcctccgccttcggtcaggccatggccgtgaccccgctgcaggtctgcactgccatctcggcggcggtcaacggcggctatcttgtcaccccccatgtggtggataagatcaccgaccagaacggcaatgtggtcgaggaggttggtgcgaacgtccgtcgtcaggtcatcagcgagagcgccagcgagaccatccgccagatcatggagtacgaggtgggcgacggctccaccaacggcggcggttccaatgcctacgtcgcaggctaccgcatcggcggcaaatccggcacctccgagcagctgaacatggagcgccgcgccgacggcgactacaagaaggtcgcctccttcgcggcggtcctgcccgccaacgacccggaaattctggtctatgtcatgctggacgaccccaacaacgcccgcaccgactactcctccattctggccgcgcctgtggtcggcaacatcatcagtgagatcgccccctatctgggcatcgccaccgacggcatcgaccgcagccagaccaccgtgaaggtgcccaacctcgtgagcaaggagtggagcaacgcgcaggtcgccctgaacaacaagggcctcaagcaccagctggtggagagcgagagcagccagaccgccgccgtcgtcacctaccagtaccctcatgcgggagcagaggtggccagcggcaccaccatctatctgtataccgatacctattccggcagtcacaccgaggtgccggacgtcagcggcaagagcgccgactttgcccgccagatgctgactgccgctggattgaactgtcaggtggcaggggaaagcaccggcacggtgcagagccagagcgaggccgcaggcgccagtgtccagaagggcaccgtcgttaccatcacctgcgggtaa

SEQ ID NO: 2600 - DNA, 1884 bp, Unknown
  Artificiall/Consensus sequence
atgatccttgcgaaccggaacggcctgaagaacacccggaatatgctgcgggtgttcggcgggctgaacgagacgtacagctgcaccgaggcggagtacagcgcgggcatcaacttttcggcccggaacttcccggccctgagcacccgtctgccccgccggaagctgcgggagacggcagagctgaacgggatgtatcacctgaacggtctgctgatggtctgcggcaccagactcatctacaccccggatgaccccgacgagctggaagtgaccctggagaacgcggtggaggacggaaaaaaggcgctggtgggcatcgggacaaaaattctgatcttcccggacaagctggccttcgacaccgtcagccgggaggtaagcgcactgggggcggtgtggtcgggggcgaacgccagcgtggagtttgccccctgcgacgccgagggcagggtctacgaggtgagcggcagcggcccttcggagccggaaaatccgaaggatgggcagctcttcctccgggtggaggacccggagaagccatggagcagcgagagcacgctggaggtttacagcgaggcgtcgggcaactggtcggcggtggtgctggactgctgccgcatttcggccaagggcgtcggcgcaaattttcgggccgaggacaccgtagccctcagcggctcgggcgcagagcaggccgggcagtggagcgggctggacggcgaccgcatcgtctgcgacgccagcgaggacgccctgcgggtcagggccgaccccggcggcgagtggttctatggccgtctgacccgcaccggcgcagcggtgcggtgggtgagtctggacggcagcgtcagacgggagttcgtctcggcggagacggtgaggctggagcgccgggtgccggacatggactatctgaccgagtgcgacaaccggatatggggctgttccagcaaggagaacgtcatctacgcctgcaagctgggcgacccgtccaactggttctcctaccggggcatcgccgccgacagctatgctgtgaccgtgggcagcgacggggcgttcaccggcgcggccacctgcatgggatatgcgcttttcttcaaggagaataccctccacaagctctatggctccaagccctcggatttccagctgagcagtctgcgctgccggggcgtggcaaagggcgcggcccggagcctctgcgtcatcaacgagacgctctactatctctcgcccgacggcgtgatggcgtgggatggaagcatccccaccaaggtctcgacggccctcgacccggcccggctgcggaacgtgaagtcagctctgggcggtgcgctggacgggcggtattacctgcatctcgtgcggggcagcggcgaagctcagaccgtccggctgctggtctacgacaccgagcggggcttgtggcaggaggaggacgtctgctcctacgagatgaccggcagcggcggacagctctacctctgggatggcaaggcggtctgggcggcggatgcggagcgggaggagaactggcagcgggccgacggcctcgaagagggggtacggttcgagctggtcagcggggacatcgggctggaccgcccggaagaacagtatctttcccggctgaccctccggctcgaggccgaggcgaagagccgcttcgagctggcggtgagctatgacggcggggcgtgggagacactggctcagaggacggccgacgggcggcactgcttcgacatccccttcgtgccccggcggtgcgggagcctgcggctgcggctgaagggccgggggcagatcaccctgcgcagcctgacccggacgagcgccgccgcgagaggcggcattctggcacaggaggtgaactga

SEQ ID NO: 2601 - DNA, 2949 bp, Unknown
  Artificiall/Consensus sequence
atggcagacgaaatgcacgaacccaaacgaaaaggccgctcccggcggcaatggctccctgccgccgccgtcaccctcctgctgctggggctgctggtcggcgtcagctgccagtacatctcgtatgtgtcgcagacggtctatcaggagagcacatcgcatctggaagaggtcctgcataaatccaacaatatgctgaaggagctggtgcgcaagaacctgacctatctgcatctgtacaacggctttctgaaaaatacctcagacgaaggcgaaattcaggcgtatgtcgaggaggcacagcaggacaccggatttgccgacttttactttctttcctacgacggaaactatatgaccgtgtctggcaaaacgggctacctcggcttgcagaccaatctggacgaaaagctctccgacggcgaggatatcgtcatgaatgcggtactgcccggcaaaccccagatgctcgtgttcatctgtcccgaaatacagggcagctaccggaacttcgactacgatgccatcgccatcgcgtactataacgatgctgtgctgaaagcgctggacaattctgcttttcaggggagcgccagcaactatgtggtctactcggacgggcgggtggtcatcgacaattctgcaaacgccacagaatcggtctacaactttatcgcggtgctgcgcgaccactccaacctttcggaggagcagattcttgccctctcggatgcgtttaagcagggcagcagcggaaacatgaaggtaaagctgggtgacaccagttattatctggtctacgagggcacagccgtccagagctggacgatgctgggccttgtcccggtcaaggtcgtcaatgccaatctggacaagctctggttccggacggtgcagatcgtgacaggcatcgccctctgccttgcagtgacggtcatcctgctcctcctgcgcaagaaccacgccacgctgcgccggaagaacaccgagatcctgtaccgggacgagctgttccagaagctctcgctgaacgtggacgacgtcttcctgatgctggacacaaagacctccaaagtggattacgtcagcccgaacattgagcgtctgctgggcgtgtcggaaggggaagtccggcagaacatccatgttctggataagctgcgcacgaaaaacgccccgaaaaacggcaaagtctgtctggatgggcttcgcagcgggggacagcgcgaatgggattttgagtatctgcatcagcagaccggggagcagcgctggttccacatcatcgccatgggcagcgaggtggagggcagagccaaatacatcctcgtcatgtccgaccgcacagccgacaagcaggtgaatcaggcgctttcagatgcagtggctgccgctgagaccgccaatcgcgccaagagcaccttcctttccaatatgtcccacgacatccgcacccccatgaacgccatcatcggctttaccacactggcggtcagcaacattgacgacaaggagcgggtaaaggattatctcgccaagacccttgcctccagcaagcacctgctctccctcatcaacgacgtgctggacatgagccgcatcgaaagcggaaagctccatctggaagaggtggaggtcaacctgtccgatgtgctgcacgacctgaaaaccatcgtcagcgggcagatctacgccaagcagctggaactttacatggatgccatggatgtgaccgacgaggatgtctattgcgataagacccggctgaatcaggttttgctgaacctgctgtccaacgccatcaagtttaccccggcgggcggcacggtctcggtacgcatccggcagtttgccggaaaggtgcgcggctgcgggcagtacgagtttcgcatcaaggacaacggcatcggcatgagtccggagtttgcccagaagatcttcgagccgtttgagcgggagcgcacctccacagtaagcaggatacagggcaccggacttggcatggccatcaccaaaaacatcgtggatatgatgggcggcaccatcgaagtccagacggagcagggcaagggcaccgagtttatcatccgtgtgccgctgcgcccgcaggcggagcaccgtccggtggaaaagatcaccgagctggaaggcctgaaggcactggtggtggacgacgacttcaacacctgcgacagcgtgacgaagatgctggtcaaggtggggatgcgcgcggagtggacgctctccggcaaggaggcagtgctgcgcgcacggcagtccatcgagatgagcgacgcctaccatgcctatatcatcgactggcggctgccggacatgaacggcatcgaagtcacccgccagatccgcagcctgaacgacgatacgcctatcatcatcctgaccgcctacgactggtcggacatcgaggtggaggcaaaggcggccggtgtgaccgccttctgctccaagcccatgttcatgtccgacctgcgggagaccctgatgagcgccctcggccagaagcagacggatgcagagcaggaactcctgcccgaagagaatgcggatttcgagggtaagcatatcctgctggtggaggacaatgagctgaaccgtgagatcgcgcaggagatcctgcgggagtacggcttccgggtcgatacagctgaaaacggcgcagtggcggtggaaaaggtcagcaccgctgcgccgggcagctatgatctgatcctaatggacgtgcagatgccggtgatggatggctataccgcaacccggacgatccgcgcactggatgacccggcccgggcaaaggtcccgatcctcgccatgacggccaatgcgtttgacgaggaccgccgcaacgtattggagagcggcatgaacggctttttgtccaagcccattgtgatcggcgaccttgtgcaggagctgcataagattttgtga

SEQ ID NO: 2602 - DNA, 1980 bp, Unknown
  Artificiall/Consensus sequence
atggaaagttgtgtgtttcaccctttttacaagctgaacgaaaggaaccgtccttctatgccatctgctgctctccgtcggctctcgcccctgcaatgggcagggctggacctcggcctctgcgccgtggcgctccttcttttgggggtcggtgccccggccagcccgttcttttttccgctgctcagtctctgggcctgtctcgtcctcttcgtgctggcggtctgcgtcctccgcacagcgggcgtcgagctggttttcttccactgggccgtcgtcttcggcatctgggccgtggccgtcgtctatttctactggacgttatcgagccggagctttatctacgtctgggactacgccaactacctgctcaagcaatatgacgccgaagccgcttttgcccagagcaccggtgggggcctccgttatctcttcggctcgatggccgacgattacaccaacttcatcaccctcttcaccgagtttcccttctgcctgaccgaccacaccggcgacgcctactccttcagtcaggtgttctgcatcctgccgaccctgctggtgcttctggccggcctcgtggtgaaggtcggccagctcctgaacgtgaagaaccggatgtattacttcctcttcggcatgaccctgacggcggcttatcccttcctgcggatgagcgccgtgctggcacagccggactggttcggcctcatcttcgccttcgccatcctgctgctgacgctggacttccgcttcgacaccctcgaaccggcccggttcggccttatctttctcgccactgctgccatcatcctcgcccgccggtggttcctctacttcgtggtgggctactatttcgcctatgtgctgctgctcgtcgcaggctgtgtgcggctggcaaagggcggtgcggtctctgccgccctccgccggggaaagaacctcatcctcttcggccttgcgtccgtcgccgccatggtcatcctgctctggcccatggtatcccacatcctcacctataactacgcgggccgctattcctactataacggcggcggtctggccctcgaggcattctaccacctcggacggctgggcctgttcaatctcatccttatcgcgctgggcctcgtctttgcagcaaagcgaaagctgcccgctctgccctgtctggcagggtgcgagctggtcgtgagcctgctgctcttcacccgggtccagaacaccggctcccatcagttcctgctcttcctgccggggtattttctcctcttcctgctgggtgcagccgcactggccgagggcatccagcgccatcgcaccctcaaactgggctgctgggccttcgtgctggtgctgtccgtgtcggtgcgctgctcgcccctgaccacgctggccatgccgggcttcgtcatcgagcactttcccatccagatccccgccacccggtatttcatctcgctggacaagctcatctacgaccggaaggacatcggccagatccaggccatcgccgactggatcgacgcccactgcaacgtgggcgagatcagctacatgatcccccacgatatgctctacaaccccgaccacttcaagaactgccgcctgccggaggcttccatcaacgacaagctggccttcggcttctcggtgcccggcacccacaacttccccatgcagttcttcgaggcgaagtacgtcatcacctgcgatcccttcccccagacctatgcgggcagcggggagatgtccatcaagctcaacgaacgcttcctcgccgcaaaggacgacgccttcacctttgagcagagcttcgacatgggcaacggcaccaccttcaccatctggcggcgcaccgccgcccccacccgcgcagaggtggagtattacctgagcgcctttgccgcagaggatgcccagtatcccgagatgttctcgcaggtggccgaagcgtggctcaccgcccacgggctgtga

SEQ ID NO: 2603 - DNA, 1896 bp, Unknown
  Artificiall/Consensus sequence
atgacgaaaaaacaaaagaaaatgctctaccgcatcctcgccgctctggcgctggtgctggtgctcaagctgctgccgcccctgcccatggcggcagagctgctgctctactgcatcccctacctcgtggtgggctgggacgtgctccgcaaggccctgttgggcatcaagaaccgtcaggccttcgatgagtgcttcctgatggcagtcgccaccgtgggcgcattcgcgctgggcgactacgtcgagggctgcgccgttatcatcttctatcagatcggcgagctgttccagagcgtggccgtcggcaagagccgccgcagcatctcggccctgatggacatccggcccgactatgccaacatcgagggcgaggacggcaagctggaacaggtggaccccgacgaagtcgaggtgggcacggtcattgtggtccagcccggcgagcgtgtgcccatcgacggcgtcatcatcgagggcgcttccaccctgaacactgccgccctcaccggcgagagcctgccccgcgatgtccagtccggggatgaggtcatcagcggctgcgtcaatatgagcggcctgctccgggtcaggaccaccaaggagttcggcgaatccaccgtctccaagatcctcgaccttgtggaaaattccagcatgaagaaggctcgggctgagaacttcatcacccgctttgcccgggtctacaccccggcggtctgctacggcgctctggcgctggccttcattccccccgtcgtcctgcttctcatgggccagccggcccgcttcggggactgggtctaccgtgccctcaccttcctcgtcatcagctgcccctgcgctctggtcatctccatcccgctgagcttcttcggcggcatcggcggcgcgtccgcctgcggcatcctcgtcaaaggctctacctatctggaagagctggccaacaccggcgtcgtggtcttcgataagactggcaccctgacgcagggcacttttaaagtcactaagatctgccccgtggagggcggtgcggaggaagccctcgtggaggctgctgcgctggccgagagctggtcgaagcatcccatctccctgagcatcaaggccgcctacggcagggacatcgatgccgcccgcgtcaccgatgtggaagagctgggcggccacggcgtcaccgccaaggtggatggcaggccggtagcggcgggcaacgcccgcctgatggagaagctgggcctttctgtccccgatgtgccccagaccggcaccatcgtccatgtggccatcgatggcgagtatgcgggctacctgctcatcgccgatgtggtgaagccccacagtgcacaggccataaagggcctcaagcaggccggcgtccgcaagacggtcatgctgaccggcgacgccgagccggtggcgaaagccgtctcggcagagctgggcctcgacgagtaccatgcgggcctgctgcccggcgacaaggtggatcagatcgagaagctcatcgcagagaagcggcccaaggagaatctggccttcgtgggcgacggcattaacgacgcccccgtcctctcccgcgctgacatcggcattgccatgggcgcactcggctcggacgccgccatcgaggccgcagacgtcgtcctgatggacgacgacccggccaagatcgccctcgccatgcgcattgcccgccgcaccaagggcatcgtctaccagaacatcgtctttgcgctggccatcaaagcggcctgcctgctgctgggcgctctgggcatcgccaatatgtgggccgccatcttcgcggacgtcggcgttatggtcctcgctgttctgaacgccacccgcgccctctacacgaaagacctcgtgaagaaggataagctggactaa

SEQ ID NO: 2604 - DNA, 828 bp, Unknown
  Artificiall/Consensus sequence
atgaaacacagaatctcacgccgtgcctttctgcgcgggtgcggactgctggcggcctctgcggccgccgggggcctgacctcctgcggagggacgaaagcgaaggacggcggcctcccccagatcgttgtgggaagcgacacctatcctccctatatttatctgaacaacgacggcgttcccgccgggatcgatgtggagatcgccaccgaagcgttccgccgcatggggtattccacccggttcgagccgatcgactgggagcagaagaccaccctcgtggagagcggtgccatcgactgcatctggggctgcttttccatggaagggcgcgaagcgctctaccactgggccggaccttacatggtgagccgtcaggtggtcgccgtgaatgacgacagcagcatccagtccctcagcgaccttgccggaaagagcatcgccgtccagagcaccggcaagccggaggagctttttctcagcggctccgacccccgcctcccgcagggggtcgatgtgttcagcatcgaagaccgcagcatccagtatgcgctgctgggctgcggctacgtggacgccatcgcctcccatgagacgaccatcctgcaatatatgaaggacaactccgtggcgttccgcatcctgtccgagccgctgctcgtcaccgggctgggcgtggcctttgcaacgaacgacagccgggggctggacagccagctgaacgatacctttgcacagctgcgcgaagacggcacgctggagcagatcgtcggcaaatatctcgaaaacccttcgcagtatctggaggtggacaccattggaacataa

SEQ ID NO: 2605 - DNA, 1341 bp, Unknown
  Artificiall/Consensus sequence
atgaaggaacaacgccatcgatttttgtgcgcggtctgcgcactggcactggtgctgacggccgttctggcccctgccgcgtgggcagccgaggggacggacgaggcacaggctgaggcaaagaccaccctcactgccgccgatgccgcccagatgcagcaggcggacgccgctgtcacagccctcaccggcagcgaagaatacgagcagatgtcccgggaacagcggcgcgctgcggctctggatgagctggacgggctggcccggaaagggctggtgcggcgcagctccatccgcaccgatgaggagaacggcatcgtcagcttcacctacagctgcggcgtgctgggcggcatcctgttcacccctgccgacgagctggaggagatgacccttgatgccggggagaacggcctgcgccccccgcgcggcctcgccgaggcctccccctgtgcggagatgcccctgacggaggacgtccgggaggctgcagcggcccggcagaacgcccggcagagcgacgaaaacgccctgcccgacaccattggccgcgctgccatctactacgcctttgacaacacggtgaacagctcccgcttcccctattattcctatatgcagggcttctgggagggcatgggcatccgcacgaccatgaacacccgggtgacgctggctgacctgcgccggatggaccggtacgacctgtgcatcctgagcgcccacggtgcctattacacctacagctacggtgccctctggaagcgcacccgcaccgagcccatcatcctgctgacggaggagtccacattttataaggacatcgtctacagcttcgagctgctgtcccaccgggtcatcaagatgaacggcctctactgcgccacagcggatttcttccgcaatgcttaccgcgccggccagctcagcagcaccatcgtctactccgagacctgcgagtttctgggcgtcacgggcagcgtggacgagtcgatggccgaggctctgctggccggcggcgcacgggccgtgctgggctatgtgaacaacgtctacaccgtctactcccgcagtatgctctgggacaccgtcaaccatctcggcatggggatgaccatcggcggggccgtgacccacgccaaggacacctacggcgagaacgacatcatctggtacacggagcagggcggccgccgccctcacgccgcagcggcctatctggtgctctacggcgacccgaacgcccgcctgaacgtgccggccaactactcggtggcccagcgtgcggacgagatcactgtggacgacatcctcggagaagttctggatcgtgccgcctga

SEQ ID NO: 2606 - DNA, 1101 bp, Unknown
  Artificiall/Consensus sequence
atgatgaaacgcattcgaactgcgctctgcctcattttagccgctgcgctgctggcaggctgcgcctttctgcccagcgagagcgaaccggaggccttggcgtctgccgaccccctcaccggccatccgctggaatggccgggccagcgcccggtggccgtgaccatcgagaacagcaccgcctccgtcacccagtggggcatctcctccgcgtcggtggtgctggaggccctcacggaagccgggatggccaccgagctttgcctcgtctatccggcgctggccgccacccccaaggtcgggccggtggctgccggacaggacatctactggcggctgttggtgggccagcagccgcttcccgtgcagcggggcgggggacagttcgaccagaattatctggactactactccatccgcgccgtggacgcgctggaagccggacgcaccgcgttcgactgtggcagcgagtggagcaatgcgccgctgtggtacaccagcggcagcgccgtctccaaggtgctggatgcactgagcatctccgccgtcctgaccgagtcccgggtgacgagcgctgcatctgcggctgccaccagcgcctcttccgggtcagacgccgtactgaccgttccggcgcttctcccacaggaagaagacggcaagctgcccgatgccaccgcgccggacgccgtgaacgtccgggtctgctttgacgacaacaacgccaccggcttcgcctacgacccggacagcggcctttaccggatgttccacgccgacggcacgccccagctcgacgccaacaacggccagcaggccggattcgacaatctgctggtgctgttcagcgcctccgcgctgcgggacgacggcaggacctacgacttcgacctgagcatgggcggcggcgtctggctcaacggcgggcatctgtggaccatcacatggacacaggggcaggacaacactctgctgttctacgacgccgacggccgcaccatgaacatcaaggcgggcacgagctacatcgccctcgtcaccagtgtgaccgggcaggagctgaccgtcacgaattccagcggggaagaaatcctcggatga

SEQ ID NO: 2607 - DNA, 1347 bp, Unknown
  Artificiall/Consensus sequence
atggattttaaggaaatgtacgcgcagaaaaagatgaccgccgagcaggctgccgcgctggtcaagagcggcgactgggtggactacggctggtgtgtcaacacccctgtggccgtggacgccgcccttgcaaagcgcctgccggagctggagaatgtcaacttccgcggcggcatcctgatgtgggtgcccgagatcttccagatcgacgatcctgctgcccacatgacttggaacagctggcatatgggcggcatcgagcgcaaggccatcgcacagggcttttcgttctactcccccatccggtattctgagcttccccgctattaccgcgaaagccccgacccgctggatgtcgccgtctttcaggtgacgccgatggacgagcacggctacttcaacttcggccccagcgcttctcatctgggcgctgtctgcgaaaaggccaagaagatcgtcgtcgaagtcaacaccaatatgccccgctgcctcggcggcatggagaactgcgtccacatctcccgggtcaccggcatcgtggagggcagcaacccgcccattggccagatggccgctgccggccccgcttctgaggtcgatttgaaggtcgcaaatctcgtcgtgccccagatccccaatggtgcctgcctgcagctgggcatcggcggtatgcccaacgccatcggcagcctcatcgcccagagcgacctgaaggacctcggcgtccacacggagatgtacgtcgatgcctttgtggacatcgccaaggccggcaagatcaccggcgcacacaagcagctggacaagggccgtcaggtctacgccttcggtgccggcacccagaagatgtacgactacctcaacaacaatcccgagtgtatgtccgcccccgtcgattacaccaacgacatccgcagcatctccgcactggacaacttcatctccatcaacaatgcggtggacatcgacctgtttggtcaggtgaacgcggagagcgccggtatcaagcacatctccggtgcaggcggccagctggacttcgtgctgggtgcctacctctccaagggcggcaagagcttcatctgcctgtcctccaccttctttaataaaaagaccggccagctggagagccgcatccgtcccacgctggaaaatggcagcatcatcaccgacacccgcgccaacctgcattatctctgcaccgagtacggctgcgtcaacctcaagggcctgaccacttgggagaaggctgaggccctcatcaacgtggcacaccccgacttccgtgagcagctcatcaaagaggccgagaagatgcacatctggcgccgcagcaacaaaatctaa

SEQ ID NO: 2608 - DNA, 708 bp, Unknown
  Artificiall/Consensus sequence
aagcccccgcgagtaccgccagagccgtgccgtccgcacccgcaccccggcctgaaccgcaagatcaagatgcaccaaaaggcgtcccgtgccttcgggacgccttttgatgtctgtgcatggaaaaatgaggcggaatgtgctacaatagaagccagacgtgcgctgcggcgcacagaaagaaagggtggaaacggaatgtttcgtggagcaagacactctgatttggagcagatcttagacatctatgcccgtgctcggaaggtgatggccgcttcgggcaacccgacccagtggggtgacggctatccgccgagagagatgctggaagaggacatcgacgccaacaggttgttcatctatacggtcaacggccggcttgaggcggtgttcgccttcattctggggccggaccccacctatgcaacgatcgagggcggcaagtggctcaacgacaccctgccctacggaactatccaccggctggcctcggcgggccatcgcaaaggcgtgacggacgaggtcattacatggtgtctcgagcactgcgagagcctgcgcgccgacacccacgaggacaacaagatcatgcagcatcttctcgagaagaacggctttgcccgctgcggcatcatcttagcggatgacggcaagccccgcatcgcctatcagaagctgtctgcgactctgcctctgcgggcagaataa

SEQ ID NO: 2609 - DNA, 1446 bp, Unknown
  Artificiall/Consensus sequence
atgctgcagctttcctcgttgctggaagaaaatctggaggcgctcaacgctaggtttggcgcttcagcggatttttatgccaagcgcatcgagctttatcactgcccgggggccatcgtgctcttcgacaacatggccagcctcgaagcgctctgggcgctcctgctggacgctgccacccgtcatacgcccggcctcgagccggagcagctggcccacagcggcgcacaggtctatgaacttctgatgcaccactccggtctgcccgccgagaacagtccggtcaaggatatggaggacctcgtccgccgcctgaccgccggcatggcggtgcttttgctggatgggtgcaaaaagggcatcgtcttctcggtacagggcctcaagtcccggtcggtggaagaaccctccggagaaggaaacctgcgtggctcccgggagggcttcgccgaccttctgcgggtcaatctgagcctgctgcgccgcctcatccgcaccgacacccttgtgatggagacggcacaggccgactgtgccatgaagaccgagtacgccatctgctattgcagggacagagccagcaggcaggctgtggcccgggtgcgccggaccctccaagaggcaaagccggagcttttgctggactccagctacttcgtgccgtggcttttcccagccagatgtcgattgtttgctccggtgagctacaccgagcgcccggcttccgccgcggcaaagctctgcgaagggaagatcgttgttttagtcaacggcagtccctcggcgctggtgctgccctccctcttctgcgaaaatttcgactgcctcgacgactacgcgactacggcgctcttttcgtccttcctgcgcatcctgaaatatggttcgttctacctcagcatcttcctgccgggggtcttcgtctgtctcgcagtctacctgcccgagcttatcccgcctcagctgctctataaaatcgaggcggcggaaaaggccacgccgcttccgctgttcgcggagatgctgctggtcattctcctgctggagatcatccgggaggccgggcttcggatgccccagacgctgggccactcggtgagtcttgtggcggcgcttatcatcggcgatgccgccgtcggggccgggctgatgagtacaccggtcatcctcgtggccagcatcacggccatatccgtcttcgtcaccccttcgctgtacgagcctgccaccctgctgcggctgggtgtcacgctggcggcgggtctggccgggccggtggggctggtgtgcgcggctctgggggttctggcggcgctgacgtccctctccgcgatgggggtgccctacctttcgagcgttgtcttttcaggggatggtatcatccgccgcaactaccgggcgctgtctcgccgcccattcaccatctggaaaaggagggggtcttaa

SEQ ID NO: 2610 - DNA, 1446 bp, Unknown
  Artificiall/Consensus sequence
atgaagaaatttgagaaaaagagcgcaggcccgctggagcgcctccgcctgaaaagcggtatatacgccgcctctttcaccgtgctggccatcctgctggctgtcctgctcaacctcatcgtccgggctgtcccggcgaagtacaccgagttcgacctttcggaggcggggctttactccctcagcgacagctccaaggagatcgcccggggccttacgcaggatgtgaacatctattatctggccgagacgggcagcgaggacgccatcctcacaaagctgctggaccgttacgcctccgagagcagccacatccggtgggagcggaaagaccctgctgtttacccgacctttgcagcccagtatggcgttcagtcggcggagaacggcagcctcatcctcgtctcgggggagaagagcgtcgtgctggaagcatcggacctctacgattacgactactccgactactacgccaccggcagctacagcgtgaccttcggaggggaaaacaagctcaccgctgccatctaccgcgtcaccagcggcgagacgctccatacctactataccaccaaccacggcgagcaggccctgacggacaccctcatcgacgccttggagggccagaacctcgcggtcagcccccttgacctgctgacggatgccatccctgacgactgcgacctgctcatcgtcaacaccccgcagcaggactttgcagcggcgggcagtctcgtggatgagatgtcggccctccgcgcctatctgaaaagcggcggacgcctgatgctcactaccgacagctactactccaccccaaacctcgacgccctgatggccgagttcggcctgagccggacgccgggccttgtggtggagggggacagcggccactccctgagcggctacccctactatctgctgcccgactacgccgaagacaccgggagcggcacactggacggcatcgacaccagccgccgggtgctgcttcagatggcgcagggcatcaccctcaccgagacggagggcgtcacctccgagcctctgctggtcagctcggaaagctcctacagcaagacggcaggctacgagatgaccaccgccgggcaggaggagggcgaccccgacggccccttcacgctggcggcttacgcctccaacaacgccaccggcgctgaggtcatctgggtcaactgcggcaatatggacaacgaggccgtctaccagaccgtccccggcaacgtgaccttcttacagggctgtgcggccgctctggccgggcaggaggggacgaccctcgtggagtccaaggcgctggaggctgcgcccatcaccatcccgaaccacaccgccgccgcgctggggctggtgttcgttctcatccttccggcggctgtgctggccgtgggtgcagtggtcgtactgctgcgccgccgcagataa

SEQ ID NO: 2611 - DNA, 1923 bp, Unknown
  Artificiall/Consensus sequence
atgatggaagattaccgcagcgccctgcgtgcaggccagcgtgcctaccgggccagtgtggcccggggccagtcgccctatctcgcggtgctggacgagatcattgccgacgcagacatcgtggcgcaggagcctctggggctggtggacatcccggccgagagcatcgtgggcaccaagaccgccggacgccacaccgcctttgcctccaacttcatgcccctcctcgaggacgacaccgagtttgccgtcaagtggtcgaacctctgtgaagcccatctggaagagggcatccatacccccatcattgccttcgagtacatgaaccgattctatgtacaggagggcaacaagcgggtctctgtcctcaagtattatgaggccgtcaagatccccggcaccgtcacccggctcatcccggccagaaacgacacgctggaaaacaagctctactacgagttcctcgatttctataagctctcccgcatcaacaacgtcagcttctcccggctgggcggctatgcgaaattgcagacgctggcctgcaaggccacgggtgaggcgtggacggaggacgaccggctgaatttctcggccctctacaccatgttcagccagcagttctatgcgctgggcggcggctcgctggggctgacgccgggagatgctctgctggtgtatctgtcggtgtaccgctatgccgacgcctgccagtccacccccacgaaggtgcgggagaatctggcccggctctgggatgaggtgaagatccttgccgaaccccacgctgtggagctgctgctggagccgaagcgcagcgcggagccgctgctgagcaagctgaacatcttcagctcccggcccagcgaactgcgggtggtcttcctccacgagcacaacgcccagaccagcgcgtgggtgcgcggacaggacaagggtcgtgctgcgctggtgaaggcgttccccgacaagctcttcgtcagctgccgggagaacatcaaccccgaggtggatgccgagcaggtgctggaagaggtggcccacgaccatgcggacatcgtctttaccaccagcgcccggatgcacaccgcctgtctgaaggtggcggcccagcaccccaagacccgcttcctcaactgctccctcaacgcgccccatccgctggtgcgcacctactacccccgcacctacgaggtgacgtatctgctggggatgctggcgggcatcgtttcccgcagcgaccgggtgggctatgtggccgcgaacccggtgtacggcgtaccggcggccatcaacgcctttgcacagggcgtgcgggctgtccggcccgagagccgggtggtgctgcggtgggcctgtctgtcggatgagagccatccgcaggacttctccgaccggaaggacatcgaggtcttctacagtcaggacttccgggagccggaagggacctaccgggattacggactctgccgccgcctgcccgacggcgtattgcagccgctgggcctgccggagtggcggtgggatgtctttttcaccgagatcgtccggtcggtgtttgccgggacgtgggacagtgcccccggcggcagggccatcaactactggtggggcctcaagagcggggccgagcgggtggagtaccccatccggctgggcagcggcacggtgcagctgctcaggatggccgagcgtcagctctgcgagggggagcttcaggtcttccccaccgagagctacagccagagccatgtcctccaccatgcggcttccggcatctatacgcccaaggagctgatggagatggactggctggacgagtgcgtggagggcgagctgcccagctacgacgcactggacgccaagacccggggacttctggacatcaacggtctggacatcgtgaaagggacgccgcagtaa

SEQ ID NO: 2612 - DNA, 1053 bp, Unknown
  Artificiall/Consensus sequence
ccgtcggctgacggcaccgactctcgcgcaagtgtgaggttccgagaggaaaaacgactccgccggaaggacgtcctcaaggcgggcgtggcggcggcagtggcgctggcactgctggccggcggcgcagcggccctccatttctgggagaatgaccgctatgcgaccggctccgacgaggtgggcagcgccgtcatcgcggccccggaggagcagaaggagatcacctacgacggcagcacctatcgtcagcgctccggccttgagacgtacctgatcatgggcatcgacgtcaagggcaaggccgtgggcgtggacagctacgagggcggcggacaggccgacgtccagatggtgctggtggtggacgacgccaacaagacgtggcaggtgctgcagattaaccgcgacaccatcacgaaggtgccggtgctggatgttctgggcggggtggcggcgtatgccgacgagcagatcgcgctggcccattattacggcaatggccgggagaacagctgcgagaacaccgcgcttgccgtctcgatgctgctggacgaccagcccatcgacggatattttgcattgaacatggacgccgtgggcatcgtcaccgaccttgtgggaggtgtgaccctgaccgtcacctcggatttctccgagatcgaccccacgctggtgcagggcgaagaggtgacgctggacggcgagaaggcgctgacctatgtgcgcagccgccaccacatcgacgaccagaccaacatcgcccgcatggcccgtcagcggcagttcctcgccgcgctggaagaaaagctccggcagcaggacagccagttcgcagccgaagcctatacggcgctggaggactacatggtgacggacatcgccagcggcacggccgcaaagatcggcgaaaagctcaagcagtacaaacagctcgacaccctgaccatcgacggcgagaacgtcatcgagaacggctactgggcctaccatctggacgagtccagccgggaggcgaccgtcttacagctgttttatgaaaaagtacgataa

SEQ ID NO: 2613 - DNA, 960 bp, Unknown
  Artificiall/Consensus sequence
atggaaatgcccctcgtcagcatcatcctgccggtgtacaatgcccagagccatctgaaccgctgtcttggcagcatctgtgcccagcagtatgaggatctcgagatcatcgtcatcaacgacggctccaaggaccagagcctgcccgtctgcgaggagttccgcaaaaaggacagccgcatcctgctggtggacaaggccaactccggcgtgtccgacacccgcaacctcggcctcaagctggccagcggtaagtacgtccagttcgtggacagcgatgactacatcgccccggactacacagcccggctggtggaggcggcggagcagtcgggcgctgacctcgtcatctcgccctacaccatggtcatccccgccggggcatccaagcccgaacaggtgctggaaaaggtccaggacgacctcggcgtcatgcacgttgcccgcccgccggaaacgagggaatacggcttcttgcccgcaggcatctacgacaaggacaccttcgccctccgcctgatggacaagcccgcttcgtatttttacggcgtgctctggaacaagctctaccgccgcgaccttctcgcggcccacgacatccgctttaccagcgagatgcgctgggccgaagacctcgtgttcaatatgcagtatatccagtacgccgaggtctttgcgtccatcccgcagcccggctactactacgtccagaacccccagagcatctgccacacccagatcaagcccgccaccctcgtgcagaacaaaattcaggtgttccgctactacaaagacctctacacccgcctcgggatgtacgaggaggtgcgtccccagctctacaagttcctcatcgacatcgccgagagcacctatccctccggccccttcaaaaaggtcatcgacgaggccaaagcctactggaaagagcacaaggccgagctggagcaaaggtcctga

SEQ ID NO: 2614 - DNA, 1035 bp, Unknown
  Artificiall/Consensus sequence
atgaacaaactgaaacgcaagaccctgaagatgccggtgcgctatctgatgaacaccgtgctggtggtgctgctgttcgttctgctctccttcatgacgcagaacgtcctctccacctatcagaacaaagtcctgctcaccgtgggcatcaatatcatcctcgccgtgtccctgaacgtgtccaccggctatctgggtcagctgccgctgggccatgccggatttatggctgtgggtgcttatacctgcgccctcttcaccaagtacagcccgctgccctccggcgcggcgtttgtcatcggtctggcgctgggcgctgtgatggccggcatcttcggcgtcctcatcggcatcccggccctccgcctgaccggcgactatctggccatcctgacgctgggcttcggcgagattatccgcatcaccctgaacaacatcgacgatgtgctgggcttcaagctgttctacggcgcaaagggcctcaagaacatcccgaaatactccaattactggaacgtcttcctctgcgtggtcatcacctgcttcgccatccacgccatgatgaagagccgccatggccgggctgtcctcgccatccgcgacaacgagatcgcagccgagagctgcggcatccagacgacctattataaggtcatggccttcgccttctctgcggccttcgccggtctggccggcggcctgtacgcctgctatctgggcgtcctcgacccctctaccttcggcttcatgaagtccatcgagatcctggtcatggtggttctaggcggcatgggctccatgcttggctccatcctctccgccaccgtcctgaccatcctgcccgaggccacccgcagcttcgagagctaccgcatggtggtctactcgctggtgctgatcctcatgatgatcttccgcccgggcggactgctgggcagctatgacttctcgatgagccgcattgtggaaaaggccatgaacggcgaactgttccgcaaaaagaatgctgacaaggagggcgcagaccatgagtga

SEQ ID NO: 2615 - DNA, 2088 bp, Unknown
  Artificiall/Consensus sequence
atggcaaaactcgtgatcgtggagtcgcctgccaaggcgaagaccatcggcaaatatctgggcaatgactatgaggttacggccagcatgggccatatccgcgacttgcccgcctcccagctgggcatcgatgtcgagcatgactatacgccgcagtacatcagcatcaagggcaaggaaaagctcatcaaggagctgaagagcaaggccaaacacgccgacggcgtgatccttgcgaccgacccggaccgcgaaggcgaagccatcagctggcatctggccaacatcctcggccttgacccccacgcccccaaccgcgtgaccttcgatgagatcaccaaaaagggcgtcaaggagggcatggcccacccccgcgccatcgacgaagacctcttcaacgcccagcaggcccgccgtgtgctggaccgtctcgtgggctacaagctcagccccttcctctggcggaaggtgcgccggggcctgtcggcgggccgcgtccagagcgtagccgtccgcctgatcgacgaccgcgagaaggagatcgaggccttcaagcccgaggaatactggaatgtggacgccacgctgggcgtgggtcacaagagcttcaccgcccggctggcctccgacgccaagggcaaaaagctcctgccccgcaccgaggccgaggcccgcgccatcgagcagggcctcgagggggccgagtacaccgtgaccgagctgaagaagggcaagcgcgcaaagcagcccaccccggctttcattaccagtacgctgcagcaggaggcctcccgccgtctgggcttcacggccacccgcaccatgcgggctgcccagaccctctacgaaggcgtggacatcgcgggccacggcaccatgggcctcattacctatatgcgtaccgacagcctccgcatctcggatgaggccgtcgccgccgccaaggagtatatcgccggggcctacggcgagagctacatctgcccctacaagcgcacttggaagaccaagagcgccacggcagcgcaggatgcccatgaggccatccgtccctctgtgccgggcctgacccccgatgaagtggacaagagcatcagcggcgacaccgccaagctctaccggatgatctggagccgcttcatggccagccagatggccgactgccagcaggacaccgtctccgtcaccgtcaccgccgggggctaccgcttcaaggccagtggctacaccgtcaccttcgacggctttaccgttctctacgaggaggccaccgacgagaaggagaagaaggagaccagcctgccccctctcgaggagggtcaggtgctcaagctgcgggagctgaagagcgagcagaagttcacccagccccccgcccgctataccgaagccaccctcatcaaggcgctggaagagaacggcatcggccgcccctctacctacgcccccatcatcaccaccatcatcgaccgcggctatgtggagcgggagcagaagaagctcaagcccaccctgctgggccgtgccgtggacggcctgatgctggagcagttcccccacatcgtggacgtggacttctccgcggagatggaaaagaaccttgataaggtggagagcggcaaggccgactggcacaagacggtggacgacttctacaagggcttcgccgccagcctcgagcaggctgagaagaacatggagggcaagaaggtcaaggtgcccgatgaaccgtccagcgaggtctgcgacctctgcggacgccccatggtcatcaaggtgggcaagttcggcaagttccttgcctgcagcggcttccccgagtgccggggcaccaagcgcctcgtgaaggataccggcggcatctgccccaagtgcggcaagggccgtatgctggagcgcaagagcgccaagggccgcatctactacggctgcgagcgctaccccgactgcgacttcatgacctgggatatgccggtgcccaccaagtgtgagaagtgcggctccaccctcttccgcaaaggctccaagctctactgtgcaaaagagggctgcggcttcgagatgccggtgccgaaaaagggcgattaa

SEQ ID NO: 2616 - DNA, 1365 bp, Unknown
  Artificiall/Consensus sequence
atgagttcatccacaaagtcactgaccgaaggccctctggccaaacagatccttctggtcagcctgccgctggtcctgtccaacctgctgcaggtcctcttcaacatgtcggacgtggccgtggtgggccgcttcgcaggctctaccgccctcggttcggtgggttccaccagcatcttcgtcaccctgttcaccggcttcctcatcggcctgagcaacggcatcaatgtgctggtggcccggttctacggcgcacgccatgccagcgatgtggaaaagaccgtccactcggccctgctggtcagtctggcggcgggcatcctgctcctgctcgtcggcctgctgggttcaccggccctgctccacctgctcaacaccaaagaggacctctaccccggtgcagtgctctacctgcgggtctacttcctcggtatgccggcgctggccctctataatttcggcaacgccatcttcagcgccatcggtgagacgaagaagcccctctattacctctgcatcgcgggcgtgctgaacatcctgctcaacctcttcttcgtcatcgtctgccgtctggacgtggcaggcgtggcgctggccagcgctatctcccagtgcgtctcggccttcctcgtcctgcgggcgctgacccgcgtgaaggactgctacgccctcgacttccacaaagctgctctcgaccctgccactacccagcgcatccttgcgctgggcatcccggccgggcttcagaacgccatttttgccatcgccaacctcttcattcaggccggtgtcaactccttcgactcccttatggtcaagggcaactctgccgccgccaatgccgataacctgatctacgacgccatggccgccttctacatggcctgtgccagcttcatgagccagaactacggcgcgggcaagcccgaccgggtgaagaagagctacttcatcagcctcgtctactccttcggcgtcggcctcgtgctgggtggtgccctcttcctcttcgggcgggaattccttgccctcttcaccactgagagcgccgtcatcgacgccggtatgaagcgtgtgggcgtcatgggctttgcctattgcatctcggcctttatggactgcaccatcgccgcctcccgcggccttggcaagacggtggttcccaccgtcatcgttgtcctcggctcctgcgtgttccgggtcatctgggtctacaccatcttcgcccacttccacaccatcccctcgctctacctgctctacccctgctcctgggcgctgacggccatcgctgagatcttctacttcgcccactcctacaaggagagcatgaagatcttctcccagcctgccgctgagctttaa

SEQ ID NO: 2617 - DNA, 1212 bp, Unknown
  Artificiall/Consensus sequence
tgcgaagcaaagacggagagggcaagcccgtttgaaaaaggagataaaccaatgtttacgataaaaaccctgaacgccatcagcccggtggggctgacaaagctgaacaagaacctcttcgacgtgtcggtggacgctgacgccccggacggcatcctcgtccgcagcgctgacctgctgaacaccaccttcaacgacggcctgctggccatcgcccgcgccggtgcaggcgtcaacaacatccccctcgaccggtgcagtgagcagggcatcgtggtcttcaacacccccggcgccaacgccaacgccgtggccgagctggtcatcggaatgctcatcgcaggcagccgcaacgtgcctgctgctgcccagtggacgcagggccttgccggagatcccgccatggcaaagagcgtggagaagggcaaaaagcagttcgtgggcaacgagatcaagggcaagaccctcggcgtcatcggtctgggtgccatcggctcccgcgttgccaactgtgccatcgagctgggcatggaggtctacggctacgacccctacatctccatcgatgctgcgtggaatctgagcagtcaggtccaccactgtgtcaacctgaacgatatgctgcctctctgcgactacatcaccatccatgtgccctatctgcccaccaccaaggacaccatcaacgcccaaacgctggccctctgcaaagacggcgtcaagctgctgaactatgcccgcggcgagctggtcaacaccgacgccctgctggaggccctcgacaccggcaaggtgtccggctacatgaccgacttcccctccgaggccctgctgggccgtccgggcgtcatctgcacgcctcatctgggggcgtccaccccggaagcggaggacaactgcgccgtcatggctgcgcaggagatcagcgactacctcaagaacggcaatatcacccactcggtgaatatgcccgaggtgcaccagccccgcgccggaggcaagcgcatctgcatcatccacaagaatgagccgggcatgatcagccagatcactgccctgaccaccgaggcaggcctgaacatcgagaacatggtcaacaagagcaagaagaacatggcctacaccatgctggacgccaccggcgcagtggacgccgcgctggctgcgaagctctcggcgatccccgccgttatccgggtgcgcatcctgtaa

SEQ ID NO: 2618 - DNA, 1299 bp, Unknown
  Artificiall/Consensus sequence
atgagtaccgagaagaagaaagaacagcagcttttggaggagctgagcgcccagcctgcggcccggtcttcctacagcacggcaggtctgagcagccgcagggaggtggagaatgcgctggcaaaggcggagtacagccccagccagagtgtgaccgacgcggcggccgacttgaagaactggcagcagaaccgcccgggccagtacgagagcgcctatcagggccggatcgaagacctcatcggtcagctgctggggcgggacagcttccagtacagctacgcacaggacccgctctaccgccagtatgcccggcagtacacccagaacgcccgcaatgccagcgcagatgccgccgcacaggcagcggccctgaccggcggctacggttcgagctatgcggtcagcgcggcgcagcaggcgtatcagcagcagatgggtgccctgaacgacgctttgccctccctctaccggctggcgctggatacctacaacagcgagggcgacgatgtcgtgacccgcatcgaccagctcaatgcgcaggaacagaacgcacaggcgcggtataatgcggagctgtcggactactatagtcagctcgaccggaagggcagcgcctacaacgccgcctatgagcaggactatggccgctatcaggactatctgggtcggctggacaccctctacggctattactccgcgcaggaacagcaggcgcgtgccaaacgtcagcaggcattcagcaatgtgctgagtgttctgggcgtcatcggcgacgcggtgcagctggccatcaccggcaccaccggcatcggctcgctggtgggcagtctggcgaataccggctacaatatgtacgccaaggaccgcgcctatgaggccgagcgtgctgatgctgcgtggagccagcagatgcaggagaaccagcggcaggacagtctggcccagcagaagtacaagaacgagctggccgagcggcagtatcaggacaccctgcgtcagcaggagttcaacaacaatgtcaccaacgagaagctgaacatcgccaagggcgagtgggcgctcaagcagtccaaggcggcccagagcgcccagcaggccgcggcaaatgccggggcaaagagtgcgggtgtctcgggcggggagccggtgctgactttgggcggcacggtcgtgccctacagcgccgcacgcctctaccgtcagggcaggagcgatacggccatccggagcgagctgctgaaggagggctactccaacgaagagatccagaatatcctgaagcagctgggaagctga

SEQ ID NO: 2619 - DNA, 1179 bp, Unknown
  Artificiall/Consensus sequence
atggcgaaacattcgaagcgctctgcttccatcttctgttacccggtgctgctcgcattcagcctgtttttcgtggggctgttcgccctcgacctcatcaccccggacagggcctatagtgagctggaaaacaccaccctctcccagcggcccagcctgtccagcttctcggcagacggcctgaacaagttcttcacggcctacaccaagtacgtcaaggatcaggtggcgggccgcgacaactgggtcgccctccagagcaccgtagagaccaaggtgatgcagaaggagcagagcggcggcatcctgctgggcaaagagcatatgatgttcccccgcacctacggtctggtctccagcgagacgcgcaccctgcccaagaatacagccgcccttgaagccctctgccggcggtacccgggcctcgtcaatgtgatgctggtgcctgcggcgtccgctgtctaccctgagaacgtccccacaggcgctcccctgctggacgaggaccgttatctcgacgccctctcggaggccgtgcagaccgccggaggccggtttgtggacgtgcggcagaccctcgccgaccacaagggcgaatatatctactaccgcaccgaccaccactggacgagcaccggcgcatactatgcctaccagcagctctgcaccgcactgggccttacgccctttgacccctcggcccatacagcccggacggcagagggcttctacggcacccactactccaaggcccggacgcccgacgccgagccggacaccatcacctactacgacctgcccaacgccctgaccatctacaccgtcaccgccccgggccagcccgccgagggcgagaccaccggcctctacgacacggacaagctttccgtctacgacaagtacgccatgttcctccacggcaacaacggcctgagccgcatcaagggcgacggcaccgggcgcggtcgaattttggtcatcaaggacagctacgccaactgcttcgtgccctacctgacggccaactatgccgacatcgacgtggtggacttccgcaactacaactacggcctcgaccagctcatcgcggacaacggctatgaccagatcctcgtgctctacagcttcgacagcttcaagagcgacccctacctctaccgggctggtgccgcaggctga

SEQ ID NO: 2620 - DNA, 1314 bp, Unknown
  Artificiall/Consensus sequence
atgttgaaaatcaaaggatggctgcgggctgcggcgctgacgctggcgctctgcctgctgctgaccgggtgcagcttccccatgcaggagacgatacaggtggaggagctgctgcgcgcgccccgccttgcgggcgattacggtgcgctgcaagcggccctgaacgactggctgggggagagtgcccagctgaaatacccgatgcagggcgacctgctttcccccttcgtcctacaggactttgacggcgacggccagcaggatgcggcggtgttctataccacggccctcacctccaatgtatgcgtcgcctttctgcgcaagaacagcgagggcagctggcaggtgagccagacggtagagggcctcgccgacacggtggacaatgtccggctggcgcagcttcaggcgggcggcacggcccagctggtggtgggttatacggcttcgcaggaggaccgttatctggcggtctattcctacgagaacggcgaggtgtcggccatcctcgagcaggcctatgagcagtaccttgtggaggacatcaccggcggcggcaacgaagacttgatcctgatgtccacgcaggagggcagcggcgtccagatcgagctgctgaccgtggacaaggacggacgtttccagcaggtggccgtgatggcgctgtcgggggataaattctcgggctgcgcctcggtggcggcaggactcggtgcggacggcaggcactatctggtgctggacggctggacgggcatctcgggcaacaatctggcctcggtgctgctgcggttcgatgaggagagccagcagatggtgcctgcatctcagatcagcagcgaggagctgtacaacgcctccctgcgcaacgtgcccaacctcgtgagccgggatctggacggcgacggcacggtggagatccccacccagcccgacgaggcaggcctgctgaacatgagccagagccgacggatggacttcatcgtctggatggattacactgccgctgcgccggagaagagcttcggccttctggacgaggagacgggctgctatatcgccctgcccatcgagtgggagggcaacctgatgctgaccgacagcgcggaggtggaaggtgccgtggagctgcggacagtggacgagaataagctggtgctgaccatccggatggcctcttccagcgagagcgcggtgggctgggtccgtctcggcgtggtggcgtcccgccagatgcaggcgaagctcggcccggatgtgactatcgaggacccggattaccggctctcccggtcgctgtatcggctgaattaa

SEQ ID NO: 2621 - DNA, 1434 bp, Unknown
  Artificiall/Consensus sequence
aaggagactgacgccgtggtcttcagcaccatcatctttctgctgcgctttctgcccatcacgctggcgctctattacctcgcgcccccgaagctcaaaaacaccgtcctcttcctgtgcagcctcgtgttctactgctggggcgaggtgcggtttttcccggtcatgctggctctcatccttatcaactacctctgcggactcgggcttgagcgcttcgaccggaaccggacggcccgcctcgttctgctgctcatcgcactggcgggcagcctcgggatgctcttctacttcaagtatgcaaactttgtgctcagcagcctcaacgccctcttcggcaccagctttgcgtccatcccgggcatcagcgtgctgccgctgggcatcagcttctacaccttccagaccctctcctacaccatcgacgtctaccgccgggacgtaaagaccgagcacaacatcatcgacttcggcgcttacgtcgtcatgttcccccagctcatcgcaggccccatcgtcaagtaccgggacgtctccgaccgcctccacgtctacaaaggccgctataacttaaagcagatcgaggagggcatgaccttcttcaccttcggtctggcgaagaaagtcctgctggccgacgccgtcggcgccctctggaccgacatcatcggggtagcggacagcccctccgtctccttcgtgggccttgccaacgcctccactccgctggtctggctgggcgtcatcgcctactccttacagctctatttcgacttttccggctactccatgatgggcatcggcatgggcaagatgctgggcttcgactttccccagaacttcaactacccttatatctccgcctccatcaccgagttctggcggcgctggcacatgaccctctcgggctggttccgggagtatgtctatatccccctcggcggcaaccggaagggcctccggcgtcagatcttcaacctcttcgtcgtcgagctgctcacgggcatctggcacggcgcgaactggaacttcatctgctggggcttatactatttcgtgctgctggctctggaaaagctcttcctgctgccctatctgaagaagggcagggtctggccccatctctacaccctcttcctcgtggtggtgggctgggccatgttcgtgggcaacgacgcgggcgtggagttcgggctgctgttccaaaagctctttatcccctccggcggcgtgatgcccctttacttcctgcgcaactacggcgtgctgctggcggtctctgtcctctgctgcaccccgctcatcgaaaagctgtgggaccggctttcccgccatgccgtcaccaaggcgctgaccattctggccctcctgaccatctcgatggcctatgtcgtgggcagcaccaacagcccgttcctgtatttcaacttctaa

SEQ ID NO: 2622 - DNA, 1308 bp, Unknown
  Artificiall/Consensus sequence
gtgagaagaaaggctctgtcccttggcctcgcagcagcgctgcttctgtgcggcggtacacagaaaaacgaaaggacggccgcagccttggtacaggctgcagccgcctccaccatccagagcagcacagcaagcccggaaagcggcagcatcacgccggaacagttcggggcgaggggcgatggcagggcagacgaccagcaggcgttggagtccgcgatgcagtgtgccagcgccgccggtctgcccctcgagctgacggagggggcggtctaccgcttttcctcccagcttgagctgcccagcggcctgaccatccggggcaatggagctgtcctgctcagcgacatccagtatgagacgctggggcaggaccgtctggccgtcggcatcatcggaaggtccaatgaggaccgcgcacacgacatccggctggaaaatgtcaccttccgggcggcggacagctgccagagcaactgcctgttctgggtgatgcgcgcctgcaatgtggaagtcgtggactgtaccttcgactgccagcccaacgactggtgccggggcgctgccgacctgtacggggtcaatgagaacatccgcttcgagggctgcgtattccgccagctgacgggcggcacggcaggcggcatctgggtgcgcaactggacggatcaggcagagagccggaatatccgttttgaggactgtgatttttacaagtccggtgcagacgaggtcttagccgtctggggctggggcggcgctgtgcgggaggtcgtcctctcgggctgtggcttttatgagacagagacggaggagagtctggcggcaggcaaccgtccggtgtggttcatcacactggggcagagcggcatcaccgatgtgcggatggagcgctgcaccatttgggcggaccgctgcgaggtcatcttccacatggtgggcgacaagacccatgccgtcgtggacaactgcgacatcaccctgaaccagccggacgatgtggccgggcatgacatcagaaagagcgcgaatcccatgctggcgcagggcaatggccgcgccgacggcagtacggtcatccagaacagccgtattgtcctgagcggcgacgatgggcggcgcatcagctatcggctcagcgccctgaaggacaatacgctggaagtttccctcgggcacggcatcgccagcaccagcgaggtcagcggcaataccatccggggacggatacagcataagatctttgaggactgctccaacgtgtggaataatcatgtaaatgtgcggagattctcgcttccgggatga

SEQ ID NO: 2623 - DNA, 1878 bp, Unknown
  Artificiall/Consensus sequence
atgtcaaacgattccgacaccctgcgcaccctgccggagcgggacttccgcgcccgggcggggcttgtggcgggggtgttttgtctcatctgcctcgggctggcggtgcggctgctgttttggcaggtggtgggcggcggctggtacgcccagcgcgccctcggccagcagctgcgggacaccgtcgtccccgccgaccggggccgcatcaccagcgccgacggcctccttctcgcggccaacagcagctgctggaccctccggacctccccccgggagatgccggaagaccgccttacccttgcggccaagggcctttccgaccttctggcgctggacgaaaagaagctgctggaaaagttcagcgaccgccgctccaacgactgtcttctccgctaccgggtggaccgtcagaccgccgacgccgtccgggacttctgcgaggccaacggcatcaccggcatccgcatccagcaggattccaagcgctggtatccgcagggagaatttctcgcgtcggtgctgggcttcaccaacgtggacaacgcaggtgtctcgggcctcgagctgaagtatgacgacctgctcaccggcgagaacggcgtggtgctgaccgccgtgaatgcgtggggctacaccctcgagcagagctatgagacagagatcccgcccaccgagggggacggcctccgcctcaccatcgacacgaatatccagcactacctcgagaacgcgctgggctatgcagtgaaggaacaccatgtggcggcccgggccgtgggcatcgtcatggacgtgaacaccggggcagtgctggccatgtccaccaccccctcctacgaccccaatcagccccgggtgatcgctgacaaagccgcccgggaggccgtggagggtctgaccggcagcgagcgggcggcggcgctccagctggcccagcagacccagtggcggaacaaggccgtcagcgacctctacgagccgggcagcgtttttaagctcatcacctgcgcggcggcgctggacaccggggccatcggcaagcattccagcttctactgcggcgactccatctcggtagcaggcacccgcttccactgtgccaaccacaagcgccacggggcgcagaccgtgacgcaggcgctggaaaactcctgcaaccagagcttcatccagatcggtgcacggctgggcaaagaggctttctgcgactacttcgaggccttcggactccgcgcccccaccggcatcgacctgcctgccgagccgaaaaagagcctctactacaccgccgagcggatggggcctgtggagctggcctcctgcgcctttggccagagcagcaaggtctcctacctcgagatggcggcggcggtctgcgccgtggtcaacggcgggcggctgatgcagccctatgtcgtttcggacatcctcggcccggagggcgaggtcatcgaccatctcgccccggtctgccgccgccgggtgctcaaggaagagacctcccgcaccatgcgggagatgatggaggctgtggtgctctacggcggcggacggaacgcccagatcccgggctaccgggggggcggcaagagcggcaccagccagaagctggacagcgccgacgagaaagcccggatcgccagcttcgtggccgtggcccccatcgacgacccccagtttctctgcctcgtctgtctcgatgagcctcacagctggacgacggcgggaggcagcctctcggctccggtctgcgccgaggtccttgagcagacgctggtctataagggcatcccccgggccagcctccccgctccctccaccgctgagacctccgccgacctccccgaagacggcgacagcttcgatggggcgtaa

SEQ ID NO: 2624 - DNA, 741 bp, Unknown
  Artificiall/Consensus sequence
atggcaaaatactattgcatcctcttcgatgcggacaatacgcttctgaatttcgacgctgccgaaagcaaggctctggctgaaacgctggtggaatatggaatcgagccggacgccgagacggtgcagacctaccgcaccatcaacgaagagctgtggcgtcagctggaaaaaggccagatccgccgcgataagctgatgggagagcgttttacccgcttcctcaaggccatcaatgcagcaggcgatggcgtggagatgaaccgctgctacctcgagcgcctgtccacccaccccgacctgatgacctccaatgtgctggatgtcctcggcgagctttcggaggtggcgacgctggcggtcgtgaccaacggcttcgagaaggtacagagccgccgggtggcggagtcgggcatccggaactaccttgaggacgtctttgtctctgagaagctggacagcgaaaagcccagtcgccgcatctttgacgccgctcttcgcgcactgggcgtggaaaaccgggagcacgttctggtggtgggcgacagcctcaccagtgacattcagggcggcgtgaatgcaggtcttgacacctgctggttcaatcccggccatgcggagaacccgggcaaggtgacacccacctacgagatcgcctcactggaagagctgtatcctctggtgatggagccggaagagctggcgaacctcggcctcaagcaccgccgccatcagccgtaa

SEQ ID NO: 2625 - DNA, 807 bp, Unknown
  Artificiall/Consensus sequence
atgtgcgaagcccccggaagcgtagtaactctgctctgttccggcatccagctttacagcgccgagcggcgtattgcggactgcattcttgcagatgtaaagcgggcgtccatgtgtacgtcggccgagctggcccgtctgagcagttcgtccgaggccaccatcacccggctgtgccacaagctgggcttcgagaactaccgcaaattccagctggcgctggcgcgggatgccatggagcagcaggagaccgcccggcgcacccgggaggaagggcaggacgagctgcgtcaggccctgctggacattcaggccaaccgggaagaggagctgcgggccaccattcaggccatcgacacccggcagctgcggcgggtgctctcgctgctgcgcagctgcgaggtcatcgaggtggtgtctgagggcagaagccttccggtggcgctggatgcatccatccggttcagccatctgggcaagcggtgcgtcgccagcgccctccacgaaaagacgctggcttttgcgcagacgctgaccccgaaggacctcctcatggcgttctccacctccgggcgggatgccgggctggaagaggtgatctctgccgccaaggtgaggggtgcgccggtgctgctcatcacctgcgacagccacagcccgctggcccatctgtccgactatgtgatgaccgcctccaaccgcgaacagcggctcatcgagggcagccacgcggcatctctcctctcgccgaacatcctcgtggaggtgctctattatctgctccggatggagaaagcgcgaatgtaa

SEQ ID NO: 2626 - DNA, 2298 bp, Unknown
  Artificiall/Consensus sequence
atgaatacggtcaacagacccttccgcaagaaggacgccatgcagctggtgacgggccagcccgtctatatggacgacctcgtccccgccgactgcctcatcgtcaagctcctgcgctccccccacgccaacgccatcgtgaagagcatcgacaccgctgtggccaagaaggtgcccggcatcgaggccatctttacatgggaggatgtgccgcaggacgcccgccgctacacgcaggcaggccagacctacccggaggccagcccctacgaccgcctcctcatcgaccgccacgtccgcttcgtgggcgacgttgtggccatcgtggcgggcaaggacgacaaatgcgtcgataaggcgctgaaactgataaaagtcgcctatgaggtgctggagccggtgctggactatcacaccgccaaggacaaccccatcctcgtccaccccgaggacaactgggagagcctgtgccccgtgggcgcggacaacaagcgcaacctctgcgcccacgacgagtgcagcgacggcgacatcgacggggtgctggccgactgtgacatcgtcatcgaccatgtctaccacaccaaagcctgccagcaggccatgatggagaccttccgcacctattgcagcatcgacctctatggccgtctgaacgtcctcagctcgacccagatcgtcttccacgcccgccgcatcatcgccaacgccctccacatcccgaagtccatggtgcgggtgacgaagccccgcatcggcggcggctttggcgcgaagcagaccgccgtctgtgaggtctacccggctttcgtgacgtggaagaccaaaaagccctccaaactcatcttcacccgagaggagagccagatcgcctccaccccccgccacgagatggagatccacctccgcctcggcgcggacagggacggcaccatccgcggcctcgacctctacaccctctccaacaccggcgcttacggcgagcacggccccacgacggtgggcctttcgggacataaatccatccccctctacggcagggccgaagccttccgctttacctatgatgtggtgtacaccaaccatatgtcggcgggtgcctaccggggctacggcgcgacgcagggcctatttgcggtggaatccgccgtcaacgagctggccgcaaagctccatatggaccccttcaagctccgggaaatgaatatcgtgaaggaggggcaggtcatgcccgcctactacggcgcggtgaacaccagctgcgccctcgaccggtgccttgcaaaggtccacgagatgataaactgggacgaaaagtacccctgccgcgatatgggcaacgggaagatccgtgccgtcggcatgggcatggcgatgcagggctccggcatctccggcatggacgtgggcagcgccaccctgaagatcaacgatgagggcttctataccctcctcatcggcgctgccgatatgggcaccggctgtgacaccacgctggcccagatcgccgccgaggtgctggaatgcggcatggacgacatcaccgtctacggtgccgacaccgacacctccccctacgactccggctcctatgcgtccagcactacctacatcaccggtaaggccgtcgaaaagtgcgccctgaagctgcgcggtcagatctgcaagctgggcgcgcagctgctgggctgtggggagagcgacgtggaatttgacggtaagacggtgtttgtctctgccgaccccgcccggagcgtcccgctggccgacattgccacggcctccatgttcggccacgatgtgccgctggaggtcacggagacccatatgtcgcccctgtcgcctccgccctatatggtgggcgcggctgaggtagaggtggacaccgagaccggcgaggtgaagctgctggagttcgacgcctgcgtggactgcggcacccccatcaacccgaaccttacccgggtgcaggccgagggcggtctgctgcagggcatcggtatgaccctcaccgagaacatcacctacgaccagcggggctggcccatggaaaattcgctcatgcagtacaagatccccacccgcgccgacgtaggccatatccgggtcgagttcgagaacagctatgagccgaacggccccttcggcgcgaaatccatcggcgaggtggtcatcaacaccccgctgcccgccatctcggacgccatctacaacgccatcggcacccgcttctacgagctgcccatcacccccgagaaggtcgccatggctgtggccgaacaagcaggcgaagtctga

SEQ ID NO: 2627 - DNA, 2160 bp, Unknown
  Artificiall/Consensus sequence
atgatgtttcagcctcaattttatggattgaaatcttttgttgctatttacacatctgtaaacgatgtttacaaagtagtgaagcatagagagagctttttacgggtcaatcttctctgtaatatagagagaaacctcgctttttacctctatttatggtataattccgagaagaggtttatgatgaaaaaatttcgtttatcgttcatccattatgtgttaattggttttatttcatttgcaattttagcaatttttttaagaatctttggcaaaggctatgtaactctcattgcaatttttttagtcttagctggattgattgctttatttgaataccagttacaaatttcagagttagatgaattagaacaaatacaatatgttaaccatcaggcagaaagcggattagcatccctccttgataaaatgcctgttggagttatcaaaattaatgaagaatcaaatgaagtagagtggttcaacccttatgctgaattgattttttcaacagatgatggggactttgatgttgaatcattgaaaaagttactcaacactctgtttgaggataaaggtcattttgtcactgtagccgataagaaatattccgtttactttgatcagacgtctagtgttgtttacttttttgatgtttccagtgagtatgaagcaactgtgggattggtgacaactcgtcccgttatcggtattatttctgttgataactatgatgatctagaggatgtcatttcagactctgatattagcaatatcaatagttttattgccaactttgtagaagagtttacagctcattaccatatgttttacagacgtgtggggatggatcgtttctatttgtttacagactatacggtcttagaacagttgatggaatcaaaattttcagtcatcgatcaattccgtgaagaagctaaaaagcgtgagctacctattaccttaagtatgggattctcttacggtgacggcgagcatgatgagattggtaaagtggctctcttgaacctaaaccttgcggaagttcgtggtggggatcaagcagttgtcaagaaaaatgatgaacagaaaaaccctattttctttggcgggggaacagcttcggctgtgaagcggactcggactcgcacacgcgctatgatgacagctatttcggataagattaaatccgttgatcaagtcttcattgttggacatagaaacttggatatggatgctttaggagcgtctgtgggaatgcagtttttctcaagcaatattttggcttcctcttatgtggtctatgacccgcatgcaatggctagtgatatttcaagagcgattgcaaaactagaggatgagcaggttacaaaactccttactgtagaggaagctttgcaaatggtaacggatcgctccttgctgattatggtggaccatgctaaaacagcattgaccctatctaaagaattctataaggaatttcaacagattatagttattgaccatcaccgtcgtgatgatgattttcctgaaaatgttctgatcacttatatcgagagtggtgcaagtagtgcgagtgaattggttagtgaactcattcagttccagaaatcgaagaaaaatcggttaacgaaaattcaagcaagtgtcttgatggctgggatcatgctggatactaagaacttctctgcacgtgttacgagtcggacctttgatgtggcaagctatcttcgctcgagagggagtgatagcgtagccattcaagagatttctgcaattcagtttgacgagtaccgcgaagtgaacgagctgatcttaacaggtgaaaagattttgccacatatcatcgtagcttgtgccaacacgactaaagcctatgattcagtaactattagtaaggcagctgatagtatgttggccatgtctgaagtggaagcaacctttgtcattgcttgcaaccaaagtgggaccatctcgatttctgcacgaagtcgaagcaaagtcaatgtacagcgtatcatggaacaacttggtggaggaggtcattttaattcggcagcctctcaaattgagggtcaagatttgatgagtattcgtcaacaactgattgagactattgaaaacgaagtaattattgaaaaggagaatgtagaatga

SEQ ID NO: 2628 - DNA, 2568 bp, Unknown
  Artificiall/Consensus sequence
atgaataaaacaaagctaaaaacatccctttttatagtatcttctttcctgattccagctatcataatgttctttatttacctttcacaaggaatctactggaacagtgatacatccccattgttaggagatggttatcatcagtatgtcatttttgatactacacttcgaaatattttacatgggacagatagcctattttacagttttcaaagtggactaggtattaatttctatgcactcagtagctattatctaggaagtttcttttctcctcttgtatacttctttaatgtacaatccatgccggatgctgtttacctcatcactcttcttaaatttggagcaattgggctaagcgcttatattagtctacatggaatcttttctaaaatccctagatgcctggttcttactctttcaacctcatttgctcttatgagctttgccatcagtcaaattgaaatcaaaacttggctagacgtttttatcttggcaccattaattctttatggattcaaaaaactaatttacaatgagggagaggttctctactttatcagcttaaccagcttgtttatccaaaattattattttggatttatgatgtctatttttctcattttatggtacttgacacaactgtcatggaacataaaaaaaattggaaaacggttctttcattttgtgattgtatctcttttatcagttataacaagtcttgtgatgttatatcctaccttcttagatttacgcactcatggagaaagtttttcaaaggttgacagtatctttacagaaaaaagttggtatcttgacgtatttgcaaaaaatttcattggaagttttgacactactaaatatggatcaattccaatgatctacgtgggattatttccacttctattagcgatcacctttttctttgtaaagtcgatcaagtttcacgtgaaactttcttacattatactcttgaccattcttattttgagttttcgttttcaattattagatctcctttggcaaggtatgcacgcgccaaatatgtttcttcatcgatactcttggatcttttctttgacgattattctgatggcaggagaagtactaaatcgaatagaggagatcacttggattcgttttagttttgctaatttcctcctcattctaggatttggagcaactgtcctttacagcaatcactataaatttttagatgcagtcaatttcattgttacttttgaatttttaattgctttctatttggtctgtttaggatttatcctaaaaaaaataccgcctagacttttctatctttcgatcctttttttctccatctttgaattatcggtgaatagttattatcaaatggaaggaattgcgaatgaatgggtctttgcttctcggtcatcctacgaacgcgacttaaaagccatccaatccttagtaagaaggaagacagactcaaattatcggactgagattctacagccacaaacgggcaatgatagtatgaagtatggttataatggaatttctcaattttcatctgtacgaaatacggatgcgagctcgacattggacaaacttggatttaaatctgaaggaaccaatctcaatcttaggtaccaaaataattctattttaatggatagtctatttggtgttcgctataatttgagccaacaacctgttcaaaaatttggatttaaagagattgcaaccaaaaatggagtctcactttcagagaacgaatatgccttaccaatcgcctttttgtcagcaaaaacttataaaaatgcttcctttacaaatttaacactggataatcaaacacgattcatccatcaaatcacggatgaaaaatataaattttataagaaattaaatattctgtcgcatacttcacaaaatactacatcttcgttgcaaactgcaaaaattgaagaagatagtcatctatcctacgcaagtattcaatatgaagtaatggttcctgcccatagccaactatatgtcaatgttccaaatttacaattttcaaatgatgatcggaaagagattgaaatcagctacaatggacagaaccaacgctatactattgataacgcctttccattcttttcgattggccattttgacacaggggaaacagctactattcgtatgagttttccagaaaattcgacagtctcctttgatacaccagaattttttgctctggatcttgaccaatatacacaggctatcaccaccattcatcaacaagaagttgccattcacaaaaataaaaatagagtggtagcaacctataacgcagatagagatactacccttatttttacacttccttatgataaaggctggtcagctaaacaaaatggaaaatctatccaaattcatcgcatccagaaaggattgatgggagttcatgttccaaaaggatcaggaactgtcaccttaacatttattccccaaggcttagttgagggaggcatttcctttttcgttggaattattctctttttcctctacgaatggagacaaataaaaagacgaaaaaactaa

SEQ ID NO: 2629 - DNA, 1464 bp, Unknown
  Artificiall/Consensus sequence
ttgattgggagcgagaatgataaaaaaggagtttattctgaaatggataagtttttcaaactttcagaacatggaaccactgttcggacagagattcttgctggtttgacaactttttttgcgatgagttatatcctcttcgtaaaccctcaaatgttgtcacaaacaggtatgccagctcaaggggtcttccttgcaacgattattggatccgttgtcgggaccttgatgatggctttttatgccaatttaccttatgcacaagcaccaggaatgggcttaaacgctttctttacctttaccgttgtatttggtatgggctactcatggcaagaagctttgggaatggtcttcatttgcggtgtgatttcattaattatcacattgacaaatgttcggaagatgatcatcgaatcgattccgacagctcttcggtctgctatttcagcggggatcgggattttcttggcctatgttggaattaagaatgcaggatttttgaaatttacgattgaccctcatacctatacagtggtcggagaaggagcagataaggggaatgcaacgatctcagccaatgcatctgctgttccaggcttggttgattttaacaatccagctgtcctcttggctcttgttggtcttgcgattaccatcttctttgttgtcaaagggattaagggaggcattatcctttctatcttagtgacgactgtgcttggaattctcatccatgtggttgatatcactaaaattgactttgcaagtaaccatctaggagctgcctttaatgatttgggcacgatctttggtcaagctttgggttcgaaaggattgggttcgttgatttcaaatacctctcgtttacctgagaccttaatggccatcttagccttctccttgactgatatttttgatacaattggaactttaatcggtacgggtgaaaaagttgggattgttgcgacaaatggggaaaaccatcaatcagcgaaattagataaggccctctattcagacctagtagcgacttcagtcggagccattgcaggaacttcaaatgtaacgacttatgtcgaatctgcagccggtattggagctggtggacgaactggtctgacagccttggttgtagcgatctgttttgctatttcaagtctctttagccctttgttagcgattgtaccgaccgctgcaacagcaccaattttgattgttgttgggatcatgatgttgagtggcttgaaaaatatccattgggaagatatgtcagaagcagttcctgctttcttcacctctatctttatgggcttcagctactcgattacacaagggatcgctgctggatttatcacctatagcttggtgaaagtggttaaaggagaagctaaagaagtgcacagcatgatttggattttagatgttctctttattttaaactacgttagcatggccttgaattag

SEQ ID NO: 2630 - DNA, 2793 bp, Unknown
  Artificiall/Consensus sequence
atgaaactcaaagaaacattgaatcttggaaaaacagcttttccaatgcgggctgggcttccaacgaaagaacctgtttggcaaaaagaatgggaagatgcaaaattgtatcaacgccgtcaagagttgaatgaagggaaaccgcattttacacttcatgatggccctccgtatgccaacggaaatattcacgtgggacatgccatgaacaagatctcaaaagatatcattgttcgttccaaatctatgtcaggattttacgccccttatattccaggttgggatacccatggtttgccaattgagcaagtcttggctaaacaaggtgtgaaacgcaaagaaatggacttggttgagtatttgaaactctgccgtgaatacgctctttctcaagtagataaacaacgcgaagacttcaaacgcttgggtgtttcaggtgattgggatcatccttatgtgaccttaacgcctgactatgaagcggcgcaaatccgcgtctttggcgaaatggccaataaaggttatatctaccgtggggctaagccagtttactggtcttggtcttctgaatcagctcttgctgaagcagagattgaataccatgatttggtgtccacgtcgctttactatgctaacaaagttaaagatggtaagggtgtcctagatacagatacttacatcgttgtctggacaacaactccatttactgttacagcttctcgtggattgacggtaggtgcagagtttgattatgttgtagtgaagcctgctggatctgaccgcaagtacgtcgtagcctctgaactcttgccaagcctttctgaaaaatttggttgggaaaatgctgaagttcttgcgacttaccaagggaaagaattgaaccatatcgttacagaacacccatgggatcctgaagttgatgaattggtgatccttggtgagcatgtaacccttgattcaggtactggtatcgtccataccgctcctggttttggtgaggatgactacaatgtagggattgccaatggcctcgaagttgctgttactgttaacgaacgtggaatcatgatggagaatgctggacctgactttgcaggtcagttctatgacaaggttgttccaacggtcatcgaaaaacttggtgatttgctccttgctcaagaagaaatctctcactcctacccatttgactggcggacgaaaaaaccaatcatctggcgtgcagttccacaatggttcgcttctgtatcaaaattccgtcaagatatcttggacgaaattgaaaaagtgaaattccactcagaatgggggaaagtgcgtctttacaatatgattcgtgaccgtggtgactgggtgatctctcgtcaacgtgcctggggtgtgcctcttccaatcttctatgcagaagatggaacaccaatcatgacggctgaaaccatcgaacatgtagcgcaactctttgaagaacatggttcgatcatctggtggcagcgtgaagcgaaagacctcttgccagaaggatttacgcatccgggttcaccaaatggcgaatttacaaaagaaacagatatcatggacgtctggtttgactcaggttcatcatggaatggggttgtggttaaccgtcctgagttgacttatccagcggatctctacctagaaggttcagaccaataccgtggttggttcaactcatctcttatcacttctgtggcgaaccatggtgtcgcaccatacaaacaaatcttgtctcaaggtttcgcattggatgggaaaggtgagaagatgtctaaatctcttggaaataccattgctccaagtgatgttgaaaagcaatttggtgccgaaatcttgcgtctctgggtaaccagtgtagactcaagcaatgacgtgcgtatctcaatggatatcttgagccaagtgtctgagacttaccgtaagatccggaatactcttcgtttcttgattgccaatacttcagactttaacccagctgaggatgcagttgcttatgatgagcttcgttcagtggacaagtacatgacgattcgctttaaccagcttgtcaagaccatccgtgacgcttatgaaaattttgagttcttgacgatctacaaggcgctagtgaactttatcaacgttgatctgtctgccttctacctggattttgccaaggatgttgtttacatcgaaggagctaaatccctcgaacgccgtcaaatgcaaacagttttctatgatatccttgtgaaaatcactaaactcttgacgccaattcttcctcacactgctgaagaaatctggtcttatcttgagtttgaagcggaagacttcgttcaattgtcagaattgccagaagcagaaacgtttgccaaccaagaagaaatcctggatacctggtcagctttcatggacttccgtggtcaagctcaaaaagccttggaagaagcgcggaatgagaaagtgattggtaaatcacttgaagctcatttgactgtttatccaaatgaagttgtgaaaacacttcttggagctgttgatagcaatgttgctcaactcttgattgtttccgagttgaccatcgaagaaggaccagctccagaaggtgcagtgacttttgaagatgtagccttcacggttgaacgtgcggctggtgaagtttgtgaccgttgccgtcgcatcgatccaacaactactgaacgtcactaccacgcaaccatctgtgatcactgtgcaagcatcgtcgaagagaactttgcggacgcagtcgcagaaggatttgaagctaaataa

SEQ ID NO: 2631 - DNA, 2853 bp, Unknown
  Artificiall/Consensus sequence
gtggcaagatatttagtagggccttacaacaatagttggaactttatggatgcgcttgaaaaagcgcaggatggagataccatcgagtttgaaaatgggtatgtgtttcaatggccgacagatgaggtaattgtgatcaacaagagccttcattttgtggggcatgtagttccaaatccaaatggtaatgggcgcatgtttaacaacacgattgaggcttctttccgatttgtagagggagctcaggtgacatttgaagatctgtggtttaaagttggtgggaactatactgccttgaccttatggaatgagtcagctatcacttgtaaacaggtctattttgaaattaccactccgacaaatagtgaattttttatctatatggatacgcattcgaaaatgacattggatggagttgggatgaaggttccggaaaaacaccaaagtgtcatcggaatgtcagcatcagaactgtccattcaaaattcaacgattttttctaagatagatctgtcagaaggatctaaattgaccttagaaaatgtccatattgaaaaatttgggaataatacgatccatgccaaggactcagaagtgatcgcaaaaaattcaacgattacaggcggggatctggaaaaggactttccaccagtttggttgaggaatgtcatctgggagtctgaaaactgtaaaattgagttgcctactggaactggagtctgtcttgacaataatgttcaattcaattcggattccgatcgtatcacctctctcaatgcattcaatagtatgatccgagctcaccaggctacattttcagaatttttatgcgtctatgaagagtcctttgcttccctgactggagaaacgaccttcttgaatgagaatgcccaaaccatttcgtttggagtttttgatgatggtgtgctgatggctgagcatatgatttgtcataagattgcggatcctaatatacggcttcaaggtggagcctttgcgaaggtgggcaccgtgacctataggcagggcgatgcgcgtgatctgaccaaggaaatcgaggatgactgtgactatcttgttggcagagaagtggccaagggcaatgcgcaagtcgttcctacgggacaggcgacggatgcaacggtggctccaaccaccgcaagagactctgggccagagaagaaacaagatgcccttcaagaactcaatagcctgattggtcttgaaaaagtcaaacatgagatcaagaaaatgatcaacatggtggaatttaacaagaaacgaatcgccagtggcaaggcacctgaaaaacaaaccttgcatgctgcctttatgggaaatcctggtacagggaaaacgactgtggctcgtctgttgggaaaagtgctctttgatgcgggtgttctctcaggggaagaattccgtttcgtggaagcaacggagtccgatctgatctcttcaaatattgggggaacggctgaacagacccaagccctgcttgaaaaagcgcgaggaggcatcctctttattgatgaagcctatagcttggataaaaaggatagcggtgcggattttgggatcgaggcgatcaataccatcctcaaatttatggaggacaatcgcgatgacatcatgattatctttgccggctataccaaggaaatggaagagtttttaaagactaatccaggcctccgttctcgggtaccaaataatttcatctttgaagatttcacaggagatgagattgtccaactgggtgaaatgatcctaagcaaaggagactacaaactcgaagaccgggattactatgcgcggcatgttaagcgggcttatgatggctcgctagataagagcaatggtcgctggatccgtaacctggatgagcaattgaccaagaccatggcggatcgggtggtggcccaaggttctgacgatattgagaccatcctcaatagcgatatcgatgctgtccttaaccaaggtaagtatcaagcaggagccgacaaggaagaagatgggatggctgccctcaaccgtttggttggaattgctaaggtgaaagagcaagtcgaacaattcgtagccatggctgagttcaatcaaaaacgggctgaacaaggtggcatcgtcgaagacacgaccttgcactctctctttcttggaaatcccggtacagggaagaccaccgtggcccgcattttgggcaatatcctcttccaaaaaggggttatcaagcagaagaaattcatcgaagtttcgcggagcaatctggttggaggctaccaaggtcaaacagccttgaagacgcgtgaagttttggagagtgcactgggtggagtcctctttatcgatgaggcctacacgctctataccggtttaaatgatgattttgggaaagaagccttggacgaagtcctcaaatttatggaggaccaccgccgcgatatcgtcattatctttgctggttacacgaaagagatgcacgacttcttgcaggtcaattcaggtctgcaaagccggatcccgactacatttgattttgaagactacagcccagatgagatcgtggagatcggtctgttaggtttgcgtaagcaaggttaccaggtcaatgaagccctttatggagagattgtgaaagggaattatatgcgtgccaatgaccatagtaatggtcgctgggttcgcaatctcaatgaaaaactcttgcgccaagtatcaactcgggtaacccgtgaaggtagtacagactacaattccattttgaatcaagatttggaagcattgagagagaatagcagttctgaacaaccccataccgtggatgatcaaggttatgttcttccttaa

SEQ ID NO: 2632 - DNA, 2385 bp, Unknown
  Artificiall/Consensus sequence
atgactgtcgattataacagcaaagcttacttggataaagtagacgcttggtggcgtgcagccaactacatttcagctgctcaaatgtacttgaaagataacccattgttgaagcgcgaagtcgttgaaaatgacttgaaagctcacccaatcggacactggggaactgtaccagggcaaaactttatctatgctcacttgaaccgtgccatcaacaaatacgacttggatatgttctacattgaaggaccaggtcatggtggacaagtaatggtgtctaactcatacttagatggttcttatactgaattaaatccaaacatcccacaaaatgaagaaggtttcaaacacttatgtaagatcttctcattcccaggaggaatcgcttctcacgcggcgcctgaaacaccaggatctatccacgaaggtggagaacttggttatgccctttctcacgctgcaggtgctgtattggataatccagatgtgattgctgccacagttatcggtgacggtgaaggagaaacaggtccattgatggctggttggttgtcaaataccttcttgaacccagtcaacgatggggctatccttccaatcttctacctcaatggtggaaagatccacaacccaacgatcttcgagcgcaaaacagacgaagaattggccctcttctttgaaggtcttggttggaaaccaatctttgcgaatgttactgcgatttcagaagatcacgaagctgcccacgctttgttcgctgaaaaattggatgaagcaattgaagaaatcaagaaagtccaagcagaagctcgtaaaggttctgctgaagaagcaactcaaccagtatatcctgtcttgattgctcgtattcctaagggttggactggtccaaaagcatgggaaggaacaccaatcgagggtggattccgtgcgcaccaagttccaatcccagtagatgctcaccacatggagcatgtcgatgcccttctttcatggttggaatcttaccgtccagctgaattgttcgacgaaactggtaaactagttcctgaaattgctgaaattgcaccaaaaggtgaccgtcgaatggctatgaacccaatcacaaatgctggtgtgatcaaaccaatgaacacagctgattggaagaaacatgcccttcaattcaacacaccaggtgaaatcatggctcaagacatgatcgaatttggtaagtatgcggcagacttggtagatgcgaacccagataacttccgtatctttggtccagacgaaaccaaatcaaaccgtcttcaagaagtcttcactcgtacaagccgtcaatggttaggacgtatgaaaccagactacgatgaagccttgagccctgctggtcgtgtcattgactctcaattgtcagagcaccaagcagaaggtatgcttgaaggatatgtcttgacaggtcgtcatggattcttcgcttcttacgaatccttccttcgtgtcgtggattctatgattactcaacacttcaaatggttgcgtaagtctaagacacatacaacatggcgtaaaaactacccagccttgaacttgattgcaacttcaactgtcttccaacaagaccacaatggttacactcaccaagatccaggtatcttgactcacttggcagaaaaaactcctgaatatatccgcgagtacttgccagcagataccaatagcttgcttgcggtgatggatgaagctttcaaggcagaagatatgatcaacttgatcgtttcttctaaacacccacgtcctcaattctactcagcagctgaagcagaagaattggttcgtgaaggatacaaggtgatcgattgggcatcaactgtttcagcagatgaagagccagatcttgttattgcagctgcaggtactgagccaaacttagaagctcttgcagctatcacaatcttgcacaaagccttcccagaattgaagatccgctttgtcaacgttgtggatatcttgaaattgcgtcacccatccgttgatgcgcgtggactttcagatgaagaatttgacaaagtcttcacaactgataaaccagtcatctttgccttccatggttacgaaggcatgatccgtgatatcttctttaaccgtcacaatcataaccttcgtgtacatggttaccgtgaaaacggggatatcaccacaccatttgatatgcgtgtgatgtctgagttggatcgcttccacttggcacaagatgcagctaatgcagctcttggagaagcagcaagcgcatttgcagcgaagatggatgaaacaatcgccttccaccatgactacatccgtgaaaacggagacgacattccagaagttcaaaactggaaatgggaaaacgtgaataaataa

SEQ ID NO: 2633 - DNA, 1068 bp, Unknown
  Artificiall/Consensus sequence
atgagtaaagcaatgattcagctggaccacattgatgtgaccttccagcaaaagaaacgtcagatccaagccgtcaaagatgtgaccattcatattaatgaaggcgatatctatgggattgtagggtattccggagcggggaaatcgaccttggttcgggtgatcaatctcttgcaagtgcccagcgccggaaccatcactgtggacggagatgtgatttatcaagatcaggtgaccttgaaaccggctgcccttcgggagaaacgtcgggatatcggaatgattttccaacacttcaacttgatggctcaaatgactgtcgcagaaaatgtagcatttgctcttaaacattctaaattgaacaaagaacaaaagaatgagaaagtggcgaaattgttggatttggttggtctatctgaccgtgcagaaaattacccagcacaattgtctggtggtcaaaagcaacgggtagcgattgcgcgtgcccttgccaacgatccaaagattttgatctcagatgagtcaacttcagccttggatccaaagacgaccaaacaaattctagctttgttgcaagagttaaacaaaaaacttggtttaaccattgtcttgatcacccatgagatgcaaattgttaaagatattgccaatcgggtagctgtcatgcaaaatggcgaactgattgaagaagggtctgttttagatatcttctcgaatccgaaaaatgctttgacgcaagactttatcacggttgcaacaggaatcgatgaagccatggtgaaaatcaaccaacaagcgattgttaagaacttaccagatgattcggttctagcgcatctcaagtatgcgggttctgtgacagatacagctatcatcaatgatatttacaagcagtaccaagtatccgccaacattttatttgggaacatcgagatccttgataacacgcctgttggagaattggtggtcatcttatcaggtgaaaatcaaaatctggaaacggccaaagctgagttagaaaacgcaggagtttccgtgactattgtgaaagatgggagaaaagcatga

SEQ ID NO: 2634 - DNA, 1854 bp, Unknown
  Artificiall/Consensus sequence
atgaatgagactacagatgggactggggcaggaatgattttctttgaaaatgatttcgtctcgctccctcttttctgtgtgatcaaggaaattatttatggaaaaggagaaacatctatgctatatatttggtcttacttgaaaaagtatcccaagtggctagccctaaatctattttcggcggtcctgtttgttattgtcaatttgggcttgccaacgattctagctcgcatgattgatgaggggattaacccgcgtgatgtggaccggctgtatttctggggctgggtcatgtttgcgattattttacttgggattgtgggacggattatcttgtcttatgcggttggtcaactaacgaccagcatggtccgcgatatgcgaaatgacctctatgccaagttacaggagtactcgcatcgcgagtatgagcaaatcggggtatcgtcattggtcactcgcttgacttcggatgcctttgttttgatgcagtttgcggattctatgttgaagatgggggtcatcacacccttgatgatggtttccagtgttctcttgattctgacaaccagtccttctttagcgtggattgtagcggtttctgtaccatttcttgctgttgtcgtctggtatgtagcagtcaagacacgtccactttccgagaagcaacaaaataccctcgaccatcttaatcaatttgcacgtgaaaatttgactggacttcgtgtgattcgtgcctttgcccgtgaagaatttcaagaggataaatttgcagctgaaaatgaagtctacgcggaaaactcgaataaattgttcaaactaactggtttgacagagcccttatttgtgcagatcatcattgctatgattgtggcgattgtctggtttgctttggatcctcttcatgacggtagtttgaaaattggggatctggttgcttttattgagtatagcttccacgcgctcttgtctttcctctttttagccaatctctttaccatgtatcctcgtactgcggtttctagccgtcgtctcaaggaaatcatggatatgcccatttcgattgatccgaatgagaatggtgtaacagagacagcatctcgtggctatttggaatttgacaatgtcacctttgcttatccaggtgagacggagagtccagttcttcacaacatttcctttcaggccaaacctggcgaaacgatcgcctttatcggatcgacaggttctgggaaatcttcacttgtgcagttgattcctcgattctatgatgtaacacttggaaagattttggtcgacggcgtggatgtacgtgactacaatctcaaggcccttcgccaaaagattggttttattccgcaaaaggccttactctttactggaaccattgctgaaaaccttcgttatgggaaagaagacgcatctgtacaagagctagaacaagcagcagatatttcccaagccaaggaatttatcgacagccgtgaggaaggctttgatacgcatttggcagaaggtggtagcaacctttcaggtggtcaaaaacaacgcttgtccatagctcgtgctgttgtcaaagatccagatgtctttatttttgatgattccttctctgccttggactacaagacggatgccactttacggaagcgtctcaaagaagtcacaggagatgcgactgtcttgattgttgcgcaacgtgtgggaaccattatggatgcggatcaaattattgtcttggaccatggagagatcgttggtagaggaacccacgatgaattgatggaaagtaatgagatctatcgtgagatcgctaattcgcagctcgatagtccatcattgacagaagaatag

SEQ ID NO: 2635 - DNA, 2361 bp, Unknown
  Artificiall/Consensus sequence
atgaaaacaagtattaaagaatatttacaagagcatgacaaagcccagatcaatgatctggcagcagctctaggaaaagaagggtctaaggatttccgtgacttggtcaaaaccatctctctgatggaacgccgtcatgagttgaaattcgaagatgatggctctcttcgtttggctcaaaagaaggccccagccattaccctcaaggggatctttcatgcccataaaaatggctttggttttgtcagtttagagggcgaagaagaggatctctttgttggccgaaatgatgtcaatcatgctatcgatggtgacaccgttgagatcgtcattagcaaggtggcagaccgaaacaaaggaacggcagcggaagctaagattattgatgtcttggaacatagtgtcagaacggtagttggacaaattgttctggatgaggaaaagcctaaatatgccggctacattcgttcgaaaaatcaaaaaatcagccagctgatctatgtgaaaaagccagccatccaattggaagggaccgaaatcctcaaggtcgaaattgatcaatacccgagccgcaagcacaattattttgtggcaactgtgcgggatgtggtcggtcatgtaacagatccaggaatcgatgttttagaagtgctagaatccatggacattgtctcagaatttccagaagaagtgttgaaagaggctgagcaggttccagatgtaccatctgaaaaggatttagagggacgattggatctgcgagaggagatcacctttaccatcgatggggcagatgccaaagacttggacgatgcggtccatatcaagctactcaagaacggcaattttgagctgggtgttcacatcgcagatgtttcttattacgttacagaaggatcagctcttgataaggaagctctaaatcgtgcgacctctgtctatgtgaccgaccgggtagtacccatgcttccagaacgcttgtccaatgggatctgttctttgaatcctaatgtggaccgcctgacccagtctgccatcatggagattgatcctcatggaaaggtcgtcaagcataccattacccaaacagtgatcaatacaacctttcgaatgacctatagcgacgtcaatgatatcttagcaggcgacgaagaaaaggctcaaacctttaagaaaattgtcccaagtattcatcaaatggctaccttacacggtattctagaaggcatgcggattcgccgaggagccctcaattttgataccaatgaggctaaaatcttggtcaataaggaaggaaaaccagttgatatcgttttgcgtcaaagagggattgccgagcggatgattgagtcctttatgttgattgccaatgaaacggtagcggaacactttacgcgactgaagctgccgttcatctaccggatccacgaagatccgaaagcagaaaaagtacagaagtttatcgattatgcttctagctttgggatccagatctacggaacggctagtgagatgagccaagaagccctgcaagaaattatgcgcaaggtcgaaggggaaccgtatgcggatgtcctttcgatgatgttgttgcgctcgatgcaacaggcccgctattcagagcacaaccatgggcactatgggcttgctgctgagttttatacccactttaccagtcctatccgtcggtatccggacctgatggttcatcgaatggtgcgcgaatacggaaaatcccaagaagtggcagagcactttgaacaagtccttccagacattgccagccaatcctctagtcgggaacgccgagctattgatgcggagcgcgaagtagaagccatgaagaaggctgaatacatggaagactttgttggggaagagtacgatgctgtggtttccagtgtggtaaaatttggcctctttgttgagttgccaaatacggttgaaggcttgatccatattaccaatcttcctgaattctaccattttaacgaaagagatctaacccttcgcggagaaaaatcaggagtgaccttccgtgtcggtcagcagatccgaatcaaggtagaaagagccgacaagataacaggagagattgatttctcttatattccaagtgaatgggatgtcgtcgaaaaaggtcttaaggctaaagggcgtgaccgagatggtaatcgcagggatcgcagacgcaaggacaaaaaagtttctaagggatcaaccgctagaaaaaatgacaagcggaaagattcttcctctaaatccaaaaagaaaaaagggaagaaaccattttacaaggaagtagcaaagaaaggagccaaacatggcaaagggcgaaggaaaggtagtcgcgcaaaataa

SEQ ID NO: 2636 - DNA, 2730 bp, Unknown
  Artificiall/Consensus sequence
ttgtgcaaaagagacctagtagaaagctataaggaggaaattattttgtcaaaagaacaaaataaagctttgttttatacacagagtaaagaagaagttctaaaggaattggactcttcaattgaaggcttgtcaactgctcaagctcaagaacgtttagcgacttatggtcataatgaactggacgaaggtgaaaaacgtagcctcttgtctaagtttatcgatcagtttaaagatttgatgattatcatcttgctgatcgccgcagctctctctgtgattacagaaggaatggacggccttacagatgctatgatcatcttagccgttgttgttttgaacgcagcctttggtgtctaccaagaaggacaagcagaagcagctatcgaagcactgaaaaacatgtctagtccattagcgcgtgtccgccgtgatggtcacgtgattgaaattgattccaaagaattggtcccgggtgatatcgttcttctggaagctggagatgtggttcctgctgatatgcgcttgttagaagcagcttctcttaaaatcgaagaagcagctcttacaggggaatcggttccagttgaaaaagatgtgactggccttgttgaggcagatgctggtatcggagaccgtgtcaatatgggttaccaaaactcgaacgtaacctatggtcgtggtactggggttgtgaccaacacaggtatgtatacagaagttggtaagattgcagatatgttggccaatgctgatgaaacggaaacaccattgaagcaaagtttggaacaactctctaaagccttgacttacctcattgtagccattgctgcagtgaccttcctggttggtgtcttcgttcgtggggaacatccattagaaggtttgatggttgcagtagcccttgcggttgcggcgattccagaaggtcttcctgccattgtaaccatcgttctctctttgggaacaacaacccttgccaaacgcaattcgattgttcgtaaattgccagccgttgaaacacttggttcaacagaaatcatcgcatctgataaaacaggtactttgaccatgaaccaaatgacggttgaaaaagtgtataccaacggtcaattacaaagtgcagcaaccgaaattggagcaagcaacaatacacttcgcatcatgaactttgccaatgataccaaagtggatccatctggtaagttgattggggacccaacagagactgctttggtacagtttggtttagaccacaattttgatgttcgtgaagccttgaaggatgagccacgtgtagctgaattgccatttgactctgaccgtaagcttatgtctacgatccataaggaagctgacggttcatactttatcgctgtcaagggggctcctgaccaattgctcaaacgtgtgacgcgtattgaagtcaatggggaagttcgcccaatcacagaagaagacaaacaagctatccttgctaccaacaaagacttggccaaacaagcccttcgtgtcttgatgatggcttataagacaagcaacgaaatcccaactttggaatctgaaatcgttgagtctgacctgatcttctctggtttggtcggaatgattgaccctgagcgtccagaagcagcagaagcggttcgtgtcgctaaggaagcaggtatccgtcctatcatgatcacgggtgaccaccaagatacagcagaagctattgccaaacgtcttggaattatcgatccaaatgatacagaagaccatgtcttcacaggggctgagttgaatgaactctctgatgaagaattccaaaaagtctttaagcaatactctgtttacgctcgtgtatcgcctgaacacaaggttcgtatcgtaaaagcatggcaaaaagaaggtaaagttgttgccatgacgggggatggggtcaacgatgcaccatcacttaagacagctgacattggtattggtatggggattacaggtacagaggtttctaagggagcttcagacatggtccttgcagatgataactttgcaaccattatcgtagcggtagaagaaggacgtaaggtcttctcaaatatccaaaaatctatccagtacctcttgtctgccaatatggctgaggtcttcaccatcttctttgcaaccctctttggatgggatgttcttcaaccagtacatcttctctggatcaacttggtaaccgatactcttccagccatcgctcttggtgtggaaccagctgagccaggtgttatgacccacaaacctcgtggacgtaaatctaacttctttgacggtggtgtcttcggagccattctttatcaaggtgtcttccagaccttgctcgttcttggtgtttatggctgggccttactctctccagaacatgcgactcgtgccgaaatccatgcagacgctttgactatggcatttgcaactcttggtttgatccaattgctccatgcctttaatgttaaatcggtttaccaatctatctttaaagtgggactcttcaagaacaagacctttaactggtcgattccagttgcctttgttttcttgatggcgaccatcattgtccctggatttaacaaactcttccatgtgtctcatttaagcttgacacaatggttagctgttatgattggttcgcttttgattgttgttctcgttgagattgtcaaagcagttcaacgtgcacttggaaaagataaaaacgccatttaa

SEQ ID NO: 2637 - DNA, 2661 bp, Unknown
  Artificiall/Consensus sequence
atgcaaacaaataaagaaagacttattaacgctcttcaagaaccacttgaaagcacctttgccaactaccaaaccagtgcccttggtctagttgacgatcaagtagaagaaaaccgcgatgcttatggcgaaaatgtcatcacaaaaggtcaagaagattccatgatcaaaaagatctacgaatcgatcatcaatccttttacggtgattttgttggtcattgcgctggtttccttcatcactaatgtctggctagcaaaaccaggtgaacaggatccaacgacctctatcatcattgtgaccttggtcttgatctctggtggtatccgcttcattcaagaattgcggagcgacaaagctgccagcaacttatcacgtatgattgtcaatacagcgaccgttcttcgtgatggatcagaacaagaaattccgatcgatgaaatcgtcgtaggagatgtgatcaaactaagtgccggcgatatgattccagcagatgtggtcttgattgattcccgtgacttctttgtccaacaatctggcctcacaggggaaagtgatgctgttgaaaaggtttgtctcagaaaagccgacagtcaaaatccagatagtctcttggagagtgaaagcttggccttcatgggaaccaatgttatctccggacgggcaacagccttggtcttggtcgtcggggatgaaaccatgatgggagctattgagcaaaccatcaacacctatgacgaaccaacctcatttgagagagaaatgaataccatctcttggctcttgattcggctcatgttagtgatggtgcccgttgtctttgtgatcaatggcctcacagatggtgactggttagaagcgggtgtctttgccctcagcgttggggttggtttgactcctgaaatgctgccgatgattattaccgcgagtcttgctaagggctccatcatcatggcaaaagaaaaagtcgttatcaaaaaactcaatgccatccaagaccttggggctattgatattttgtgtactgataagacaggtaccttgacccaagatgaaatcgttttggagtatccgcttgatatccatggcgaattggatctttcagtccttcgccgagcttacttgaattcctatttccaaaccgggctaaaaaatttgatggaccgggcgattatcaatcggacccagaaagaagccaagaaacatgagattgttcgcgatctggatcaaaccttccataagattgatgaattgccctttgattttgaacgtcgtcgcatgagtgtcattgtcaaagacgaagacggtgtggtcagcatggtgactaagggtgccttggaagaaatgctttctgtatcgacttttgttgaatacaagggggagattaaacgcctgacagatgaagttcgtcaagaggtcctcgctgaagttgctcaattaaatgaacaaggacttcgtgttttgggagtcagctacaaaactgacttggacgaaaatgacatctttagtgttgaagatgaaggagatatgatcctaaccggttaccttgcctttcttgatccaccaaaaccttctgcagctccagcgatcaaagctcttgcagaatatggggtaaccaccaagatcttaactggggacaatgaaaaggtcactcaagctgtctgtgaaaaagtaggactagatgtagagcggattcttttgggaagcgaaatcgatacgatgacagaccaagagttagcacaagttgtagaaacaacaacggtctttgccaaactatcacccgatcaaaaagcgcggatcatcctctgcctcaagaataatggccacaaggttggttacatgggagatggtattaacgatgctccatctatgaaggtctcagacgttgggatctccgtggataccgctgttgatattgccaaagaaacggcagatgtcatccttctggataaggacttgatggtccttgaaaaaggtttggttgaaggccgcaaggtctatgccaatatgaccaagtacatcaagatgacggtctcttctaacttcgggaacatcttctctcttctctttgccagcatctttttgcccttccttcctatggcccccgttcatttgattgtgctcaatcttatctatgatctttcttgtatcgcccttccttttgacaatgtcgataaggatttccttaagaaacctcgtatctgggaagctaattccatcatgcgcttcatggcctggatcggtccaatttcatctgtatttgacattattacctacatgcttctttacttccttgttgtcccaatgattttaggtcatgggtacaaccatgtagcagtagatgcagcagcctttatcatggttttccaaaccggatggtttatcgaatccatgtggtctcaaaccatggttattcatatgttgcgttcaccaaaacttccatttatccaaagtcgtccagccttctcagtcgtggtgacgaccctagtagcagccttctttgtaacctcccttccatatagtcctttggcttctatcttgaagttgagccaactaaatggattgtactttgttctattgtttgcgattatcgtcctctatatgttgagtgtgacggttgtcaaacgtatctatattaagaaatacaaagaatggttgtaa

SEQ ID NO: 2638 - DNA, 6801 bp, Unknown
  Artificiall/Consensus sequence
atgggaaagtctttttttgaaaagcgtcctgtttttagtattcgtaagctctcagttggagcttgttctgttgtgattgggatttctgccttgggtctttcaagggtccatgcggaagaaaagccagccctcgaaagtgaaccgacttcgatggagacactaagtgttgtgacggaaaactcagaaacggaagttcctgaagctggtgcaagggtttcagaagctccagctgtcatcacccctaccagagctgaggaaaagccagcgcctcaaggcgaaggccagcccgtttcagcttcatctgagcgtgctacaggaacagaagaaacagctgctccagaccaaaatcgtgtagcggaggatattgtgcaagatcgagaacgtgattttaataaagattggtattttaaattaaatgcagctcctggtgcagaagggcgtcaagtggatgtcaaggattggaaaaaattagatcttcctcatgactggtctattttctttgatttcgatcacaactctcctgctcaaaatgaaggggggcaattaaacggaggggatgcttggtatcgtaagaccttccgtttggacgacaaagatctagataagaaggtccgcttggaatttggcggggtttatatggattccaaagtctatgtaaacggacaattcgtcggtcattatccaaatggctacaatgccttttcttatgatattaccccttatttgaatgcggatggaagcgagaataccattgcggttcatgtggtcaatcaacaaccaagtagccgttggtattcaggtagtgggatttaccgggatgttaagctgagtgtaacggacaaggttcatttagcgcagtatgggactacgattacgacccctcagttggaaaaacagcaaaatggggcagtagatacagtggtgaagagtcgcattgttaaccaggatgatcaagcccatagtatttatgcagaatatgaaattgtcgatcaaaatggccaagtggtgagcgaaaaaacgcgcagtgaagcacaagctgttctagcaggtcaagagatcaacctatctcaaaccttgcatgttgaaaaaccaaccctctgggatgtgaaaacggatcatccagctctctataccttgtatacgcgggtttatcgggattcgcagttggtcgatgtgcaaaaggaacgctttggctatcgctatctgaactggacgccagaaggtggcttcttcctcaatggggtggcgacgaaattccacggggtatctcttcaccatgaccacggggctcttggagctgaggaaaattacaaggctgaataccgtcgtctcaaacagatgaaggatatgggagtcaatgcgatccggacgacccacaacccagcgagtgaacaaactttgcaaattgcagctgagttgggcttgatggtccaagaagaagcttttgatacctggtatggtggcaagaaacaatacgattacggtcgtttctttgaaaaggatgccactcacccagaagcacggaaaggcgatacttggtccgattacgatctacggaccatggtagagcggggcaagaacaatccagccattgtcatgtggtcgatcggtaacgaagtcggtgaagcagatggttcagacaaatctgtcgcaactgttcgtcggttggtcaagaccatcaagaacgtggatgcaacccgctatgtcactatgggagccgataaattccgctttggtgatggctcaggaggccatgaaaaggtagcagcagagcttgatgcggttggcttcaactattcagaagccaactatgaaagcttacgggcgaaacatccacactggctcatttatggttctgaaacctcttctgcgacgcggacacggggctcttactaccatcctgaaagagaatgggtaggaagcaaccaagaagaccgccactatgaacaatcagactacggcaatgaccgggttggttggggtcggacagcgacagcctcttggacctttgaccgtgatcatgccggctatgcaggacaatttatctggaccggtaccgactatatcggtgagccaaccccatggcacaaccaaaatgacacacctgtgaaaagttcttatttcggtattgtcgatactgccggccttccaaagaatgatttttatctttaccaaagtcaatgggtatcggctgagaaacatccgatggtccatcttttgccacattggaactgggacaatccagaattagccaatcgtgtcatggatgaagaaggtcggattcctgttcgtgccttctccaatgcccacagtgtggaattgattgtcaatggggaatcacaaggagtgaagacctttaccaagaagaccacagctgatggccggacttaccaagaaggggcaaatccggatgaactctatctagagtggttggtcccttatgtaccaggtaaagtggaagctattgcgcgcaacgaagcaggagaagtgatcgcgaaagatcaagtcgaaacagccggcaaggctgcgggtgttcgtttgttgaaagaagaacatgcgatcgcagcggacggtaaggatttgacctatattacctatgaaatcgtcgataaagaaggtcgtgtcgtaccaacagccaataatttggtgcatttccatttgcatggacagggccaaattgttggtgtcgataatggggaacaagccagccgtgaacgctacaaagcgcaggaagatggctcatggcaacgcaaagccttcaatggcaaaggggttgtgattgtcaaatcaactgagcaggcgggtgcctttactctgtatgcagactcagatcgcttgcaatcagaccaagtcagcctctttacaggtaagaaggaccaagcagaacgcactgtattaggtgtggaacctgttcgacaaagtgcttatctaggagaagaaccaaccttgccaagtaaggtcaatgtggtctatagcgatggcaaagcccaagaagaagccgttgaatgggatgcggcagactatagccgtgctggccaagtccgtgtgacaggtcatgttcaaggacgcacggtcgaagctctggtcgatgtgatcggcgtggaacaagtccttccagtcatcaaacaaatcccacagggagcaaatctagcgacggtggataaggctgtgcaattagttttcaccgatgggaccactgcccactatgaggtcgatcaatggaccttggaagctggtcaagaagatcagttgtccacaccaggagcacgcttgaaagcgacaggactcctaggcaatggggaaacggtccaagcgacactagtggttgcaggaggagatgtagccgaggctaagaaaccaacggttcagctagatggagtagctcttccaaaatttggtagtggcaaccatactattttccgttccctcgcttatggtcaagagccaggtcaagtcacagcaagtgcagaaaatgcccaagtgacggtcctacaagctagccgcgaaaatggtttgaaagctcaaatctttgtaactgctaaggatacgggagcagtacagacctatgtggtacaattccaagaagaaagtccacggattgagcgcctagaattgcgtctgccagaagggcaagaactcaaggaagaccaaacggtaccacttgaagtcattgcccattaccaagatggtagtctagcgagtctgaaagcagatcaaatcgatgtgaagacaagagctggtagtcaaggaaaagcagttacgactaagaaaggtttggaattgcgggaagcagggctggttcatttagaagccaacttccaaggacaaacaggagaagtcagctttaccatcacgccaaatccagaagaaaagacggttgtcaaggtgcgtcctgtacgaatcagtaccgatcgaaacatgttgccagctcttccagaaaccgtcttggttgagtatgacaagggattccctaaagaaaaacacgtgacctgggatgctgtaacagcggatcaggttagggattaccatagctttacagtcaccggtcatgtagagggtgtggagaaagaagcccaagctcaagtgacggttgaaggcattatcgctgtagaagaagtcagcactaccactccagtcggcgaaaaaccagctcttccagaaagcgtacggacctatcactctaatggcaagacctatactgccaaggtggcatgggatgcggtcgatccgcaactcttggccaaagaaggagaagttatcctctctggtcgtgtagaaggaaccgatctttcaacgcgtcttcatattcgtgtttccgcaaacacagtcaagggggccaacgtagcagagcaatggacaggctctgtcttgccactcgcttttgcaagtgattctaacgatgcggatccagttgctaaggtcaatgataaggtcatctcctttaccgatgctccagctaaccgttggaccaactggggccgtgataatgcggaagattcggttgggatcttgtttggggattctggtatcttgactaagcgagcagtggacaacctccatgtaggtttccacgaagaccacggcgttggagctccaagtgaatatgtgattgagtactatacaggggaacaaatcccaacagttccaagcaatccaaatcgtgttaaagacgaaacagaccatccatttaacaatccagctaactggaaagaagtcagcaacctaaccgttgaagaaccggtagcagctggcaagatgaatcatttcagttttgataaagtcgacacctatgccgttcggatccgcatgaagacaccagaaggcaaacgtggaagctctatttcagagattcaggtatttgccaataaggttgcggcagaagaaaagagccaggtgaccattcgtgtcaacggtgaggttttaccaggtgttaatccaagtgtgaccgattactacatcgatgcgcgtgatcgggcttatccacaagtggaagcgacagccagccatcacggtcttgcaacggttgtgccaagtgtccatgaaggggagccaatccgtgtcatccataaagcagaagacggcaccatcttacaagaataccgcctccatctcacaagcgatgcagaaaaattgaaacaagctgtcccagtagcagtggaagcaggtagccgttttgtgaaagtcggtcaagatctggttctaccatctaccgtaggcgtttacttccaaggggacacaggctatgaacgcaaggaacttacggtggactggcaggctatcccagctgatgcgctttctcacgaaggtagcttcacgttagaaggaaaggtcctcggttatgatctgacagctcagctgactgtccgggtgtcagaaaagacaggagagaacctttctgtgaaccgtgactacaatgcagaggataccagggcatttgccagtgaaaccaatgatctcgatccaaatcaaatcgactatatcgattacatcaacgatggtggctacaacgaatactatcgttggaccaactggaagagagaaccagaacaaaccgaagcctttgctggtctcatcttcaagaaaaatggtcaagtaacagagcgtttggtcaataaagtagcggtcgacttctttgcagatcaggaaacaggcctaccaacgaaaaccgttcttgaacgctatattggtccagactttgaggttccggatgattatggcaatctgaagaatcttccagatcatccatttaaccaagcctctaactgggaagaaattccttatagcttagattatgactttgaagctggctatatctctaacctcagcttcaatgaaaccagaaccaaagccatccgtttaagaatggttcgtgatgaaaatcttaaaggaatcggaatcattgaattgagtgcctatgccccaacagaagaggctcaggcaacaactgatgtcacgatccaagtcaatggcaaagatctagaaggctttaaaccagatgtgacagattatcatctagagtatgagggggatcgtccaatcgtttcagcacaaggcaagaatggaacagccgttacggtcatcgatgctaaaagtgccaatgctccggttcttgtcaaggttgtctcagaagatggcaagctcgaaaaagtatatcaactttctctatccgcaaaagcacctacaggctcagccattcccgaagaaggggttaagaatctggtccacaccaaaccagagttggtgattgagccagaagagatggactttgaacgcctagaacgtccaaatgcggatcttccaaaaggtgagaaacgtgtggttcaagaaggtcaaaaaggccgcaaattgcgcttggtggaagtttctcaagaaaatggtgtggaaagccggaaggaactggatgcctttgtagagctagatccagtggcagaaatcacagaggtgggcacgaaagaagtgcttccagacactccacaaccagaaccacaaccgcagccagagccacaaccgcttccgaacccagagacttctcatgtctcagaaggaccagtagctaccgcaactcctcaagcatctcttgaggtcaaagcggtgcgccaggaagggacagatgcagcaggggaggaagtcgagaaaaccgctcaaacaccagcagtttcagctgctccagtttccgaaggtagattaccaaatacgggaacggaagaaagcgtcgcaagcctcgttgctggaatcctagcagcaggccttgccagtgctgtgctggacgatcagaaaaaaagatccaaaaaggccaagtaa

SEQ ID NO: 2639 - DNA, 2385 bp, Unknown
  Artificiall/Consensus sequence
gtgatcgcaaaagtaatcgtagatgtaccattgatgcagacggataaaccctattcttaccagattccatcagaatttgaggatatgatagaggcgggaatacgagtccatgtgccctttggtaaagccaatcgattgattcagggaattgtgatcgaagtattagaagttatcgatactacagaggaattgaaggcgattgtagaagtcttagactacacacctgtcttaaacaaagaacagttctggttggcagatcaattgcgaaaaagtgttttttcatataagataacaattttaaaaaccatgcttccctctctcctcaattccagttacgacaagattttgtatcctcagccgtcattggatctagcaaccaaagtgaagctttttggtaaaaaaaatgaagtcgctttttcttctttagatgtagctgatcaagctctggttatgcgcttggttagaaaaggcgatttggtattagaatacaaggccaaggataagaaacaaattaaaacagaaaaatggtatcgcattaaccaggaacgattaaaagaacttcaaccttcagcgagagctaaaaaaaggctagcattgaaagaacacctgttactagagcaaggggagcaacctttagcaggattgtatcagaatttttcacgagaagtagtggcttattttattgatcagggtgtgttagaaattactgagcgagaagtgaatcgggcggctgcttattatgaaggaaaagaacagtcccaagccctgcttttaaatacagagcagtcaaaagctgtggaaacagttgtttctcagtttggaaaaacatcaaatccttttttattagaaggagtgactggaagtgggaaaacggaagtttatttgcagattattcaggaagttctaaataaggggaaaacggctatcatgttggtccctgagatttccctgacaccacagatgacagaccgttttatctcgcggtttggtcaggaagtagccattctacactcgggcttatcaaatggtgaaaagtacgatcaatggcggaaagttgaacgtggggaggccagggtagtcgtgggagcacgctcagcaatctttgctcctttaaaaaacataggagccatcattattgatgaggagcacgaggcttcctacaaacaagatagtaacccacgctaccacgcaagggaagtcgcagtcttaagggctcagtacaatcaagcagtcttgcttcttggatctgccacaccaagtctagaatcgcgggctcgtgcaacaaaaggggtttatgaattaattcgtctaacccagcgggccaatccggcagccaaaattccagaagttaaagttgttgatttccgtgattatattggccaaaatgaagctggtaacttcactcctgttctagtggaagctattgctgaacacttgcagaaaaaagagcagattgtcttgatgttgaaccgccgtggttattccagctttgttatgtgtcgcgagtgtgggactgtggatacttgtcctaattgtgacatctctttgaccctccatatggataccaaaactatgaattgccattattgtggttatagtaaggcaattcctcgacactgtccaaattgccaaagtccttccattcgttattacggaacaggaacgcaaaaagcctatgatgaattacaagagatctttcctgaggctaaaattttgcgcatggatgtggataccacccgaaaaaaagggagccacgcagcaatattagatgctttcgggaatggagaagcggatattttgttagggacgcaaatgattgctaaggggctggattttccaaatgtgacgttagtgggtgtcttgaatgcggatacttctttaaatttaccggattatcgatcctcagagcgaacctttcagcttttgactcaggtggcaggaagggccggacgagcagagaaagaaggagaagtcatcattcagagctacaaccccaatcattatgcaatccggtttgctaaagaccaagattatgaaggcttttttgcctatgaaatgcagattcgccggcagttgggctatacaccgtattacttcacagttgggttaaccctgtcgcataagagtgaggaaattgtgatggagaagtcacatcaggttatggaaatcctccgttctggcttatccgatcaggtccaaatcttaggaccaactcctaaaccaattgcacgtacacataatttgtatcattatcaaattattgtgaagtatcgtttcgaagaaggtatgacacaggtattgaatcaaatcttagaatttacccaagaaaaagggaataaagatctgcgtctgagtattgataatgaacctcaaagtttcatgtaa

SEQ ID NO: 2640 - DNA, 2340 bp, Unknown
  Artificiall/Consensus sequence
atgaataaaaaaatcttagatattctggagtttgacaaggtcaagcaactctttgaaccctatctacagacagaacaaggggagatggagctagcagcccttactccaactgataaaaaagaaagcatcgaaacggcctttatggagctagaagatatggagcagatcctcttggaagagcctcgctttgccgtgtcgacgattcaagatgtccgtccagtggccaagcgtttggagatggaggcggccctcaatatcgatgaattactagcgctaaaagctgtccttcgggtgacacatgagctcaaggatttctacgacaacttggaaaatgtccgtctggaaaggctcaatcgcctctttgacaatttggtggatttaccacgcctacaaggtgggcttcaagctatcaacgaaggaggctttgtcgagtcttttgccagtgaaaaattggccaaaatccgccgtcgaatccaggaaaatgaacaccaggtcagagagattctccaagacctgctgaaaagcaaggccgatatgttagcggatgctgtgattgctagtcggaatggccgcaatgttctaccagtaaaaaacacctatcgtaaccgcattgcaggggtggtccacgatatctcagccagcggaaataccgtttatatcgagcctcgggcagtcgtcaatctcaatgaagaaattgccaaccatcgagccgatgaacgatatgaaatcattcagattctggaggaattgtctgacaccctgcgccctcatgcggcagagattgcaaataacgcttggattatcggtcacttggacttgatcaaagccaagtatcggtttatgcgcgattgtaaggcagtggtaccagaggttagcagcaatcgctctattcagctcttgcaactacgtcatcccttgattgaaaatgctgtcgcgaatgacctacattttaccgaggacttgacagaaatcgtgattaccggtcccaatacaggggggaaaaccatcatgctaaaaacgctgggattagcgcaaattatggcccagtctggtcttcccatcctagcagatccaggtagtcgtgtgggcatcttctcacaggtctttgcagatattggagatgaacaatcgatcgagcagagcttgtcgaccttctccagtcatatgaccaatatcgtatctatcttgaatcaagtggataccgcctccttgatccttctggatgagttgggggctggaaccgatcctcaagagggggctggccttgctattgctatcctagaagacctgcgcttacgcgggattaagaccatggcgacaacccactatccagaactcaaggcttatggaattgagactgcaggagtgcaaaatgccagtatggaatttgataccgagagtctgcgtccgacctatcgcttcatgcaaggagttcctggtcgctccaatgcctttgagatcgcccgccgtttgggcttgtctgagaccattatccaggatgccatgaagatgaccaatacggataacgatgtcaatcaaattattgaaaaattggaggcgcagaccttagaaagtcgcaagcgcttggataccattcaagaggtcgagcaagaaaatctcaaattcaatcgtgctcttcgaaaactctataacgaactgaccagagagagagaaacagagctcaataaggcgagggaagaagccaaggaaattgtggacatggccctctcagagagtgaccgcatccttcaaggccttcacgctaaatcccagttgaaaccacatgaaatcattgaagccaaggctcagttgaaaaaactcgctcctgagatcgttgacctttctaaaaataaggttttgaaaaaagccaaaaaggcgcgtgctcctaaggtaggagatgaaatcttggttatcagctatggccaacgtggaaccctggtcaagcaactcaaagatggtcgctgggaggcacaagttggcttgatcaagatgaccttggaagaaaaagaattcaacctcatcaaggctgaaaaagaagcgactcaacctaagaaacgccaggtgaatgtcgtcaaacgctcgaacacgagtgggccgagagcgcgtctagacctccgtggaaaacgctatgaagaagccatgcaagagctagatggctttattgatcaggctctgctcaacaacatggcccaagtcgatatcatccacggaatcgggacgggagttatccgtgaaggggtgaccaagtacctccgccgcaacaaacacgtcaaaagttttgaatatgccccccaaaatgcgggcggaagtggcgcgactattgttacgtttaaaggataa

SEQ ID NO: 2641 - DNA, 3654 bp, Unknown
  Artificiall/Consensus sequence
gtggttgatgtaaatcgttttaaaagtatgcaaatcaccctagcttctccaagcaaggtccgttcatggtcttatggagaggtcaagaaacctgaaacaatcaactaccgtacattgaaaccagaacgtgaaggtctctttgatgaagtcatctttggacctacaaaagactgggaatgtgcgtgtgggaaatacaaacggatccgttacaaagggatcgtttgtgaccgctgtggggttgaagtaacacgtgcgaaagttcgtcgtgaacgcatggggcacatcgagttgaaagcacctgtatcacacatctggtacttcaaaggaatcccttctcgtatgggattgactttggatatgagccctcgtgcccttgaagaagtgatctacttcgcagcttacgtggtgatcgatccaaaagatactccacttgagcacaaatccattatgacggaacgcgaataccgtgaacgcttgcgtgaatacggaccaggttcctttgtagctaagatgggtgcagaagcgatccaagacctcttgaaacaagtggatctggaagctgaaattgctctcttgaaagaagaattgaagactgcaactggtcaaaaacgtgtgaaggctgtgcgtcgtttggatgtcttggatgccttctacaaatctggcaacaagccagaatggatggtcctcaacatccttccggttattccaccagatcttcgtccgatggtccaattggatggtggccgttttgctgcctctgacttgaatgacctttaccgtcgtgtgatcaaccggaacaaccgtttggcacgtttgcttgagttgaatgcccctggtatcatcgtgcaaaacgaaaaacggatgctccaagaagctgtcgatgctttgatcgacaacggtcgtcgtggtcgtccgatcacaggaccaggtagccgtccactgaaatcattgagccacatgctcaaagggaaacaaggacgcttccgtcaaaacttgctcggtaaacgggtggacttctcaggacgttccgttatcgccgttggtccaactcttaagatgtaccaatgtggtgtgccacgtgaaatggccatcgagctcttcaaaccattcgtgatgcgtgaaatcgttgcgcgtgatatcgtacaaaacgttaaagctgcaaaacgattggtcgaacgtggagatgaacgcatctgggatatcttggaagaagtgatcaaagaacacccagttctcttgaaccgcgcaccgacccttcaccgtttggggatccaagcctttgagccagtcttgattgacgggaaagctcttcgcttgcacccacttgtctgtgaagcctacaatgctgactttgacggtgaccaaatggccatccacgtaccactttcagaagaagcccaagcagaagctcgtatcttgatgttggctgctgagcacatcttgaatccgaaagacgggaaaccagtcgttaccccatctcaggacatggttttggggaactactacctcactatggaagaagctggtcgtgaaggggaaggcatggtcttcaaagatcgtgatgaagcagtgatggcctttcgtaatggctatgttcatttgcatacacgtgtcggaatttcgaccgatagcttggacaaaccatggacagaagcgcaacaacacaagattctcttgacaactgttggtaagatcctctttaacgatatcatgcctgcagagcttccataccttcaagagccaaacaataccaacttgacagaaggcgttccagctaagtacttcttggaacctggtcaagatgtgaaagcggcgattgagaaattggaattgaacgttccattcaagaagaaaaatcttggaaatatcattgcggaaatcttcaaacgcttccgtacaaccgaaacttctgctttcttggaccgcttgaaagacttgggttaccatcattcaacccttgctggtttgacagtggggattgccgatattccggtcgttgaagataaggcagaaattattgaagaatctcacaaacgtgtggaacaaatcaccaaacaattccgtcgtggtttgatcacggatgacgaacgctacaatgccgttacagctgaatggcgtgcagctcgtgagaaattggaaaaacgcttggtggataaccaagatccgaagaacccaatcgttatgatgatggactctggagcccgtggtaacatctcaaacttctcgcaacttgccggtatgcgtggtttgatggccgctccaaacggacggatcatggaattgccaatcctttcaaacttccgcgaaggtttgtctgtattggaaatgttcttctcaactcacggtgcccgtaaagggatgaccgatacggcccttaagacagccgactcaggttacttgactcgtcgtttggttgacgttgcccaagacgtcattatccgtgaagatgactgtggaacagaccgtggacttgtgatccgtgccattactgatggtaaggaaatgatcgagccattggaagaacgcttgacaggtcgttatacgaagaaatctgttaaacaccctgaaacaggtgaagtgatcgttggtccagatactttgatttcagaagacttagcacgtgaaattgtcaatgctggtgttgaagaagtcactatccgctctgtctttacatgtaacacccgccatggtgtctgccgtcactgttatggtatcaacttggcgactggtgatgcggttgaagtgggtgaagcagtcggaaccatcgctgcccaatctatcggggaacctggtacacagttgaccatgcgtaccttccacacgggtggggttgcctcaaataccgatatcactcagggtcttcctcgtgtccaagaaatctttgaagcccgcaatccaaaaggggaagcggtcatcactgaggtcaaaggggaagtcacagctattgaagaagatgcttctacacgtactaagaaagtctttgttagtggagcaactggtgagggtgaatatgttgtcccttacactgcccgcatgaaagtcgaagtgggagatcaagtttctcgtggtgaggctcttacagaaggatctatccaaccaaaacgtctccttgctgtacgtgatgttttgtctgttgaaacatacctccttgcggaagtacaaaaagtataccgtagccaaggggtagaaattggcgacaaacacatcgaggtaatggttcgtcaaatgattcgtaaagttcgtgtcatggatccaggagatacagaccttctcatgggtactctcatggatattacagactttacagatgctaataaggatgtccttatctctggtggagttcctgcgactgctcgtccagttcttatgggaatcacgaaagcctcacttgaaaccaatagtttcttgtcagcagcttccttccaggaaacaactcgtgttcttactgacgcggcgattcgcggtaagaaagaccatctcctcggactcaaggaaaatgttatcatcggtaagattattcctgctggtacaggtatggctcgttaccgtaacttggaaccacaagcgattaatgaagttgaaatcatcgaagaagtgccattaacagatggaacagtcgatgaagttcaaacagctgaagtcgtagaagaataa

SEQ ID NO: 2642 - DNA, 1260 bp, Unknown
  Artificiall/Consensus sequence
atgcagtttattgcctttatagttatttttggagtgatcgttctcgttcacgagtttggtcatttctattttgcaaaaaaatcgggcatcctagtgcgagaattctcgatcgggatgggaccaaaaatctttgcccatattggtcaagatggaacagcttataccattcgcattctacctttaggtggctatgttcgtatggctggctggggtgaggatacaactgagattaaaaccggaacgcctgtcagcttgacagtaaatgaagctggtaaggtcgtccggatcaatctttctggaaagaatctggatcagacagcccttcccatgaatgttacccagtttgactttgaagacaaactggaaattacgggcttggttctcgatgagaccaagacctatagtgttgatcatgatgcgactatcgttgaagaagatgggacagaagtgcggattgcaccgagagatgttcagtatcagaacgccagcatttggggacggttgatcaccaactttgcaggtcctatgaacaactttatcctcagtattgtcgtctattccctcttagcctttatgcgagggggtgccattgactactacagcaacaatgttcaggtggcccccgatggggcactggccaaggtcggtgtcaaaagcactgttcagatccttcaagtcaacaacgatacggttagcaactgggatgagctgacagatgctgtcgagaaagcaaccaaggacagcaagacgactcctgaattgaccctgaaagtcaagacagacggccaagaaaaagaagtcaaagtgaagccaactaagtcagggaatcgttactatctgggtgtgacaaacggcctcaagacaggatttgtagataaactcttgtctggttttacagatacctggaatacagcgacacggattttgggagctttgaaagatattattttccactttagtctcaataaactgggtggtccggtcgccatctacaatgccagctcacaagctgctcaattagggattccggcagtgttatctcttatggccatgctctctattaatattggcatcttcaatctaatcccgattccggctttggatggcgggaaaatcttgatcaatttgatcgaagtggttcggagaaaaccactaaaacaagaagtagaaacctatatgacacttgcaggtgtagctgtaatggttattttgatgattgctgtcacctggaatgatattatgaaattatttttgaaatag

SEQ ID NO: 2643 - DNA, 2340 bp, Unknown
  Artificiall/Consensus sequence
atggaaactattgatttaaagggattaacccaaaatgaagtccgcaaaaaagttgaccacggacaaaccaatgattttacaacgaatacaagtaccagtacctggcaaattatcaagcgcaacgtctttaccttgtttaacaccttaaattttgtgatcgcggtagccttggctgctgtacaggcttggagcaatatgatctttttcgcggttatttgcttcaatgccattacagggatcatgaccgagatgcgcgccaagcggatgattgataagctcaatctcatgagtcgtgagctagtgactgtcattcgagacggggaaaaagatgcgattccacccgaaaagctcgttctgggtgatttaatgctcttgtcttcgggtgagcagatccctagtgatgctgaagtcatgtccggtatcgcagaagccaatgaggctatgctgactggtgagagtgatctggtcttaaaagaagttggcgatgaacttctttctggtagttatattgccagtggtcaagtctatgctcgtgtcaagcgagttggagcaaacaactatgccaacaaactgatgatggaagccaaaaccttgaagcctatcaattcgcgtattctctataatttagcgaaaatttctagtttcactggtaaaattatcatcccatttggccttgcactcttctttgaagcattgttgatcaagatgctgccaatcaaagattctgtcgtgaattcttcaacagctctcttgggaatgttgccaaagggaatcgctttactgacagttacgtctcttttgacagcggttattaagctcggcatgcgcaaggttcttgtccaagaaatgtactcagtagaaaccctggcgcgtgtggataccttgtgtcttgataagaccggtaccatcactcaagggaagatgacagtcgaagctctccatagcttatctgatcatttttcggaacagacgattcaggtcatcctctctgcttacatgcaatatagcgaggacaccaatcctactgctcaagctattcgcaaggcttatggggagttggagcatgcttatactgcggaaaacattattcctttctcaagtgatcggaaatggggagccatgcacctatccaaccttggaaccgtctttctcggtgctcctgaaatgctccttaaagaaaatcccgctgctgtcgtcgaagcacaagctcgtggatcgcgcgtgctcgtcttggctcacagttcagaactgatcagcatgcaggaattgaaattgcctgaaaatcttgaagggattgcggttattgagattacagaccccattcgtgaaggggcttcagatactcttgagtatttgcgctctcaaggagtggatctcaaaatcatctccggtgacaaccctgtgacggtttcttatatcgctcaacaagctggcttcaaaaattataagaactacgtcgattgttcaaaaatttctgatgatcaattagtggatcaagcagaagaaacagctatctttggacgcgtgtcccctcaccaaaagaaactgctcatccaaaccttgaaagcagctggtcggacaactgccatgacaggagatggggtcaatgatatccttgctcttcgtgaagcagactgctccatcgtgatggctgaaggagatccagcaacccgtcaaattgcaaatattgtacttttgaactctgactttaatgacgttccagaaattctttttgaaggccgtcgtgtggtgaataacattggacgaattgctccaatcttctttatcaaaacgatctattccttcctcttggctatcatttgtattgccagtgctctcttctttaacgtcaactatttgctgattttccctttcatccctattcaaatcaccctgatcgaccaattcgtcgaaggattcccaccatttgtattgacctttgaacgcaatatcaaaccggttgaaaaacacttcttgagacgttcccttctgttagccttaccaagcgccttgatggtcgtctttagtgtcttgtttattcgcctttggggagcaagccatggttggtctgcagccgatatgtctactgtatcctactacttacttggatccatcggtttcctatccgttatccgtgcttgcctgccactaaatatctggcgggccctcctcatcctcttctctgtagtaggattctacgcatctgcggtcgtgttgaaaaacttaatcgagatttccctccttacagccactactttcccagtttatctggcattgatggctatctttacaggagtctttatcctcactacgattctccaaaaatatgaatttgattaa

SEQ ID NO: 2644 - DNA, 2550 bp, Unknown
  Artificiall/Consensus sequence
atgacagtagaaaaaatatcccctggaatgcagcagtatctagatatcaaaaaagactatccggatgcctttttgctgtttcgaatgggagatttttacgaattattttatgaagatgcagtgaatgcagctcaaattttagagatttccttaacctcacggaataaaaatgcagagaatccgatccccatggcgggtgttccctaccactcggcccagcagtatattgatgttctcatcgaacagggctataaggtcgcgattgcagaacaaatggaagaccccaaagaagccaagggggtcgttaagcgtgaagtcgtacaggtgattacgccgggtacagtggtggattcgaccaagccggatagtgagaataacttcctagttgctttggatcgttcaggaaatgattttgggctagcctatatggatctggtgacaggggagtttcaggtgacgaccctcaatgacttcactatggtttgtggagaaatccgcaatttacgtgcgcgtgaggtggtcctgggttatgccttgccagaacaggaagagcgtgtgtttattagccagatgaatcttttgctgtcacatgtagagacggcgcttgatgatgttcaactcttaggggatcagttgagtgagctagaaaagaaaacggctggaaaacttctccggtatgtccaccagacacaaatgcgggaattgagtcacctcaaaaaagcccatcattatgagatttgcgatttcttgcagatggactttgcgaccaaggctagtcttgatttgacagagaatgcacggactgggaagaaacatggtagcttgtattggtatttggatgaaaccaagacggccatgggaggccgtttgttgcggtcctggattcagaaacccttagtcgatttgaaacggattcgagagcgccaggacatcattcaggtctttatggatcatttctttgaacggagcgatttgaccgacagcctcaaaggggtctatgacattgaacgcttagcgagtcgggtttcctttggtaagatcaatcctaaggatctcttgcagctaggagatactctggggcatgtgccgacgatcaagtcgattctactggggattggtgatccagtcttagatgtcttaattgcacgcttggatgaacttcccgagttgcatcgcttgattacctcagctatttctccggaagcgtctgctgttattacagagggaaatatcatccgtactgggtttgacgagcaattggaccagtaccgtgttgttcttcgggatggtaccggttggattgctgagattgaagccaaggagcgcgaagccagtggcattacaggtctcaaaatcgattacaacaagaaggacggctactattttcatgtcaccaattctcaattgagccacgtgcctgctcactttttccgcaaggcgaccttgaaaaattcagaacgctttggtacggaggaattggcacgcatcgaaggagatatgcttgaggcgcgtgacaagtctgctaatttggaatatacgatttttatgcggattcgtgaagaagttggcaagtatatccaacgtctgcaacagttagctcaggcgattgcgacggttgatgttttacaaagtttagccagtgtcgctgagtcgcaacagttgaatcgtcccctctttcatgaagagcgacgaatcgcgatcgacaaaggccgtcatccagttgttgaaaaagtgatgggagcccagtcctatattcctaatagcatctttatggatgaagaacgggatattcagctgattacggggccaaatatgagcgggaagtctacctatatgcgccaattggcgatcattgtgattcttgcccaaattggttcctatgttccagcccaaaaggccgagttaccaatctttgatgcgatttatacccggatcggagctgctgatgacctggtatcgggtcagtctacctttatggtggaaatgatggaggccaatcacgctattcgcaaggcaacgccccagtccttgattttgtttgatgagttgggacggggaactgcgacctatgatgggatggctctcgctcagtccatcatcgaatacattcacgatcgcaccggtgccaaaaccttgtttgcgacccattaccatgagttgacggcactctcagagactttgacccgtttggaaaatgttcatgttgcgaccttggagcgagatggtcaggttaccttcttgcacaagattgaactcggcccagcggataagtcctatgggattcacgtggccaagatcgctggtttgccagaagagttgctggagcgggcggatgcgattttgaccaagcttgaaggacaagcccagcaagtaccgcttgcggatacaactcctaaaaaggaagtgtcttcgcaggttgctgaacaaatgtccctctttgaggaggaggcagaaaatacggtgatcacagaattgaagaatctggatctctacaatatgactcccatggaagtcatgatggcagtcgccgaattgaaaaagaaattgtaa

SEQ ID NO: 2645 - DNA, 1608 bp, Unknown
  Artificiall/Consensus sequence
atgaattttgttattacaggtgtttttgccgcggtcattggtttagtcattggatatgtgggaactgctcttaaaatgaaagcttcaaaagaagctgcggaactcacccttttgaatgctgaacaagaagcaacgaatttacgtggacaggcagaacgcgaagctgatttgattttaaaagaggcaaagcatgaatcaagttcacttaaaaaagaagcacttttggaggcaaaggaagaagccagaaaatatcgtgaagaggtcgatgctgagtttaagtcagaacgacaagaattgaagcaattagaaagccgtttggcagaacgcgctagcaatcttgatcgtaaagacgacattttaacaagcaaagaacagtctcttgaacacaaagagcaaagtcttacagatagaactaaacacattgatacgcgtgaacaacagctggaagagcttgaacacaagaaagtagaggaactggaacgtgtcgctgctctaagtcaaggagaagcgcgtgacattattttgaatcagacggaagagcaactttcaaaagaaattgcctcacggattcgtgatgctgaattggaagtgaaagaacgttctgataaaatcgcaaaagacattcttgtccaagccatgcagcgaatggcgggtgattttgttgctgagcaaacaaattcaacggttcatttgccagacgatagtatgaagggtcggattatcggtcgtgaagggcgcaatattcgtacctttgagagcttgacgggtgtcgatgtgattatcgatgatacgccagaggtggtgaccttgtcagggtttgatccgattcgtcgtgaaattgcccgtatgacaatggagagccttctcaaagatggtaggatccatccagctcgtattgaagagctggttgagaagaatcgtcaggaaattgacaaccggattcgtgaatacggtgaggcggctgcctatgaaattggtgcgccaaacctccatccagatttgatgaaaatcatgggacggttgcaattccggacttcttatggtcaaaacgtcttgcgtcactccattgaagttgccaaactttctggtattattgctagcgagttgggtgaaaatgctaccttggcacgacgtgcaggtttcttacatgatatcggtaaagcgattgaccgtgaggttgaaggaagtcacgttgagattgggacggaattggcacggaagtacaaggaacacccagtggttgtcaatactattgccagtcaccatggtgatgtggaacccgaaagtgtcatcgcagtcattgtcgctgcagcggatgccttgagtgcggctcgacctggggcacgaagtgagtcacttgaaagctacatcaaacgcttgcaagatcttgaagaaattgcaaatagttttgaaggagttaagacaagttttgcccttcaagcgggtcgtgaaatccgcattatggttagtcctgaggcaattaaggatgataaagtgacgatcttagctcatgatattcgtgagaagatcgaatccaatcttgaatatcctggaaacattaaagttacggttattcgagaattgcgcgcagttgattatgcaaaataa

SEQ ID NO: 2646 - DNA, 2055 bp, Unknown
  Artificiall/Consensus sequence
atggaactactcctttatgcagtgatcttttcgatgattttgatcgtctcaaatgccacgaataaacttgtgccgagccttcctctgcccttgattcaaattttactagggattggttgggccctctttgtgccagaagaaaattttcatctggataccgagctttttctggccttggtcattggccctcttttatttcgagaggcagaagaagcagatattacttccgtcttaaaacactggcgggtcatcctctatttgatttttccagtgatttttatctcaaccattagtttgggctgggcagctcactccttgtggctgagccttcctttagcagcctgtatggcagttggggcagcccttgggcctacagacttagtagcctttgcttctctgtctgagcgctttagctttccaaagcgggtttcgaatatcttaaaaggcgaagggttactaaatgatgcctcaggtctagttgcctttcgagtggccttggcagcccttgcgaccggaagtttctcccttggagaggcagggatttccttaggaatctccatcattggaggatttgcggtggggatcttgacggcctttgtgaaccgttggctgcaaacattactcttgagtgttcgcgccagtgatattgccagtgaattgttattagaactgagtctccctctgttgaccttctttttagcagaagaactccatgtctctggtatcattgcagtagttgtgtcagggatcctaaaagccagtcgctttaagcacattaccctccttgaagcgcgggtagacactgtgagtcatactgtctggaatacggtcaactttatcttaaatgggtcggtctttgtcatcttaggaatggaattggaaatgatcgccaagcccatcttaagtagtcccatttacaataatcttcttttagttctttctgtctttcttttgacagccttgctctttttgattcgttttgtcatggtttacctcttttattggttccgaacggttcgactaaaaaaatcgttgagaaattatctaaaggatgccttattgctgaccttttcgggtgtgaagggaacggtttcgattgcgacgattcttttgattccaaccaagatcgaaaaagaataccctatcctactctttttggtggcaggagttacccttgttagctttattgcaggcttagtggtacttccaaaattatcagaagacaaggaagaaaccaatgactacctgatgcagatcgcgattttaaatgatgttgtcatggaattagaagcagatctaaagaatagtaagcacaagggccccttgtatgcggcgattgataactaccatggtcgcatagaaaacttgattctaggccaagaaaacaggctcattcaaaaggactgggaacagttgaagctcctgattttgagtattgaaagtgacggcttggaacaggcttatgaagaagggaagattcgagagcggggctaccgtgtctaccaacgctatcttcacaatatggaacaacgtgtcaatcgcaatctttcgtatcgtctaacctattacttcttggtgtctttccgtctcttgcgtttattagttcatgagatcttaacttttgggtctggcttgcgaaactggttgacccgagaagacagcaagttagaggccattgattatgaccagattgcagccctttatctggccaatacagaaatcatcatcgaaagtttggaagacctcaaaggggtttataggagcagtttgatctcttttctacaagaatctcgtctgagagagacggccattattactagtggagcctttgtggagcgggttattaatcgcgtgaaaccgaataatatcgatgaaatgttaagaggctattatttggagcgtaagattatttttgaatatgaagcgcaacacctgattaccgccaagcaagcacgccgtatgcgacaaaatgtcaatgaattagaaagttattccttaagagaaagtgctaatacgcttccatatgatatgatcgagtatgcacggaatcgatag

SEQ ID NO: 2647 - DNA, 1284 bp, Unknown
  Artificiall/Consensus sequence
ttgaaagagctaataattattaagatgaaaaaaattgtaataaatggaggtcgccctctaaaaggagaggtgaccattagtggtgcaaaaaatagtgtagtggccctgattcctgcaaccattctggcggacgatatcgtgaccctcgatggggtaccggatatctcagatgttgcaagtctgattgaaatcatgaccatcatgggcgctaagatcgaacgcaaagaagacagtttgatcattgatccacgtggggtgaaggatatgcccatgccatttgggaaaatcaatagcttacgagcttcctattatttctatggcagtttgttagggcgctatggtcaagcaactgttggactacctggaggatgcgatctcggcccacgtccaattgatttgcatttgaaggcctttgaagcgatgggagccgctatgactatggatggctctagtatgaaacttgcgacagatggcaagcctcttcaaggagctaacatctatatggatactgttagtgtcggtgcaacgatcaatacgattttggcagcagtcaaagctaaaggtcggacagtgatcgaaaatgctgcgcgggaacctgaaattatcgatgtggtgaccttgctcaacaacatgggagctcatattcgtggagcagggacagatattattatcattgatggtgttccgcatttgcatgggactagacatcaagtaattccggatcgcatcgaggcaggaacctatattgctcttgcagctgctattggggaaggtatccagatcaataatgtcttgtacgagcatttagagagctatattgccaaattagaggaaatgggtgtgtgcatgaccatttctgaagatagtatctttgtagaaaagcaaacaggcttgaaggccatccagatcaaaacgtctccttatccaggttttgcgactgatttgcaacaaccgatcacacctttgctcttaacggctgcaggacgtgggcgaatcgttgatacgatttatgaaaaacgggttaaccatgtgccagaattggctaaaatgggggctactatcttgactttgaacgaccacattatctatgaagggccaaatcaattgacgggatccagtgtgaaagcgacagatcttcgagctggtgcggctttagtgatcgcaggtctcatggcttctggaacaacagaaattacaaatgtggaatacatccttcgcgggtattcagatattattcataaattgacccaacttggagcagatatccagttgatagaagagtag

SEQ ID NO: 2648 - DNA, 900 bp, Unknown
  Artificiall/Consensus sequence
atggaaagtgtaggtcaaaccatgtctcacatgaaccgtgcgcgtcaatttaactatgaggatttggtcgcacagatcttggcagatcaagaagttgctgcctttattaaggaccagtctttgtctgagcaagaaattcgacgtagtatttcaaaatttaatcaatacattagtgaacgcaaccgtttcttattgggagattcggattatattgccaaaggttataagcccatcctcaccatgaatgaaggctatgcggatgtcgcttatgaggaaacgccagagttaatcgaagcccaaaaacgagctgcaatcaaccaacgtcttaacttgatcaatctcccttcgaccttgaaagaagcgagtctagccaaggtagagctcgatgataaaggacgtttcgaggcttttgaagaattagccaattttgtggccaactatcctgaatatcaaaaggggatctacctctatggtgatttcggagtaggaaagagctacatgatggcagctttggctcatgatttatccgaaaagcgccaggcttcaactaccctacttcatttcccaagttttgctatcgatgtcaaaaatgccatcagttcgggcttggtcaaagaaaccgtcgatcaggtgaaaaaagccgaaattttaattcttgatgatatcggtgcggaacagatgtcagcctgggtgcgagatgaaattttacaggtgattctgcaacaccggatgcaggaaaatctcccaaccttctttacttctaactttaattttgaagagttggagcgtcattttgcggtttcgcgcaatggagatgaaacatggcaggccaaacgtgtcatggaacgcgtgaaatttttagccaaggaaatccatttggaaggagtgaatcgccgatga

SEQ ID NO: 2649 - DNA, 1689 bp, Unknown
  Artificiall/Consensus sequence
atgaataataaagaactcattgctagtgaattggccaaagtgattgactctcttgaccaagatgctattttaaacttgcttgaacaaccaaaatcatctgatcttggtgatattgcttttccagccttctcacttgcaaaagtggaacgcaaggctcctcaagcaatcgctgcagatattgctgaaaagatcgaccaaagcgccttcgaaaaagtcgttgcaactggaccttacgtgaacttcttcttagacaaatctaagatctctgatcaggtgatcaaatctgtcattgaagcaggcgcagactacgggcaacaagacgaaggacatggtcaaaacatcaccatcgacctttcaagtccaaacatcgcaaaaccattctcagttggtcacttgcgctcaaccgttatcggggatgctctttcaaacatcttccgcaaaatgggctacaacacgattaaaattaaccacttgggggactggggtaaacagttcggtctcttgatggtggcctacaaaaaatggggtagcaaggaagctgtcgaagccaacccaatcgatgaattgctaaaactttatgttcgaatcaacgctgaaatcgaaaacgatcctgagcttgatgaagaaggacgtaaatggttcaaaaaattggaagatggggatccagaagccactgaattgtggcaatggttccgtgacgaaagcttggtggaattcaaccgtatctacaaactcctcggtgttgagtttgatagcttaaacggagaagctttctacaacgacaagatggatgaaggggttcaaatccttgaagacaaaggcttgttgaaagaatctaaaggggctagcatcgttgagcttgatgatgtgaaccttccaccagctatgatcaaaaaatcagacggtgcaaccctttatatcactcgtgatatcgcaactgctatgtatcgtgcgcggacttacaactttgtgaaaaacatctatgctgtaggtcaagaacaatccaaccacttccgtcagttgaaagctgttctgaagaaaatgggatttgactggagcgacgatatggttcacgttgactttggtttggtgacaaaaaaccgccaaaaattgtcaactcgtaaaggaaatatcatccttctcgaaccaactcttcaagaagcgatctctcgtgccaaagctcagatcgaagaaaagaatcctgaacttgaaaacaaggaagaagtggcacatgcagtcggtgttggcgcggttaaattctacgacttgaagacggaccgccgcaacggttatgacttcgacctcgaagccatggtatccttcgaaggagaaactggcccttacgttcaatacgcatacgctcgtatccaatcgatccttcgcaaagccaactttacaccatcaacagatgctacatacagcttgagcgatcctgaaagctgggaaatcatcaagcttctccaagacttctctcgtgttgtcaaacgtgctgctgaaaactatgatccatccttgatcgcaaaatatgccatcaacttggctcaagccttcaacaaatactatgcacacactcgtatcttggatgaaagccctgaacgcgaaagccgtcttgctcttagctactcaacagcagtcgtcttaaaagaagcccttcgcttacttggtgtcgatgcacctgagaaaatgtaa

SEQ ID NO: 2650 - DNA, 2799 bp, Unknown
  Artificiall/Consensus sequence
atgaaacggttaaaggaaacaaaaaaatggcctgctaaatggatacatctagcaagtctattcattctggtctcttcaatgtttgtgatgccagtaggtatattggcagagaccaccaccacgtcttcttctagtacagaggccgtactagcaagtgaagctttaagtaatagtaatgatcctgtttctggaactctatcaacatcgggagaagatagagtcgcgacagtcaatactccaaaagcagttgatgatgtgattacaagtgtgaaatatactaataatgaaggaggacttttaaattggtcattagaaccatgggcgacttttcgaattgatgccacactaaaacttccaaatcatcaagttaaagctggagatacaacaactattgcggttccaacagatttgatcattaatagtcaggattttgaagtattagatgggaaaggtcaggttgctgcatctgcaaaagtagacaaagatagaaagaaaatagttcttacctatactgattatgtggagcataactctgatatcacaggaaatatttttttctatgttcgtatagatcataagttagtaccaaatgcaaaagaaattccaatcaatttgattgtggagaacaaagtggttcaaaccacaccacctcaacctcccgttaaatatatcggtatagcacaaccccaaaattatccaatatcgaaggtaggctctatcaatcgtgataccaatgatccgattataaattatacaattggagtcaatcgtaaaccaaccaatataaaaaatgcaattatacgggatacactacaattctctaatgcacaatatgatcgcaattcgtttattgttgagaaggggcaatggctgtgggaaagtggtgattgggtctttaaaaatgctcaatctgtaccatatgagattgcatttccttctgataaaacatttgaaataaaattaggggatatttcagagaatgactcctatcgtattcgttataatgtaaaactaaactattcaccaaaagatggtgaaaaatttgataataaagttaccctaaatggttatcaaattgaagagagtagagctcaatcaaaagtattatggcaaattcctggaggacgattagatggctatatttatagcatcaaactccataagcaaaataataacggtgatcctttacagggggctcaatttaaaatcacgcgtgtatcgaataaccaaacgattacacataccgaaaatggtcaagagtcagaaatatttacaagcgatgccaatggtgacttgattgtttcaggccttttaagagataattacacggtgaccgaggttgtggctcctaatggctatcaattattgaaataccctgtatctatctcagaaaatgattttagtccagaaaattcccaatatgatgtaaatagtagagtattgacactgactatttctaatgaaaaggctaatcatcgtcaacttaaggtgacaaaaaaatggaacgataaggataaccaatataagaatcgaccaagctctattacagttaagttattaaaagatggagttgaggtagaaggcaagacattagaattgaatgctgataaccaatggagtggtatttttacggaattggatgagacaggaacatactctgtagaagaagtaggagtaccaggttatatttcaactgttgaagctaccaataatgaagacaaggaacatatcgtccttgtgaatactttggaaacgatagaagtatctggtagtaagatatggaaggatgacaataatcgagatggaaaacgtccgaaagaaattacagtaaatctacttgcaaatggtgtgaagattgatcaaacaacagtcaaatcggataaagacggtcactggaactatcagttcaaagatcttccaaaatatgaaaacggtcaagtagtggattattcgatctcggaagaaggagtacctgactatgaaacaagtgtagaggggtataatctcacaaatacctatacaccagaagtagtctctgttccatttacaaaaatttggaaagattttgataatcaagatggtgtacgtccgaactttattattgttaacttacttgcgaatggaaagaaggttgagagcagaactgtaacagctaccacagcttggacaggtagctttgatcatcttccaaaatatgaaaatggtcgagaaattgtctacacccttgaggaagaaaaggtgtcagattattctgcaagtattgatcaagttaactatatcttgaccaatacatatgtaccgggtcagacgcatctcactgtaactaaatattgggatgatgaaaataataaggatggaattcggcctaagacgatcaaggtacaactatatgcaaatggtcaaaagagtggagatgtagttgagttaagtgaagccaataaatggacctatactttttcaaatctccctgagaattctaaaggaaaagcgatttcctatacggttcgtgaagtggaagtacctcaaggttatgtagtgacagaaacggtacaaggtggaaataatatcgttctaaccaatagtcataagccaactaccccacctacaacaccgaatatacctaaaaaaccagagagtccaaaaaaaccagggaaaccagagaaaactagcaagtctacctctaagaaattccttccagaaactggtacaaagatcatgatagctttggaaattctagggttattcttgctcggtgtagcgttcatactgatagtgaggtcatctagaaaagatatttaa

SEQ ID NO: 2651 - DNA, 3018 bp, Unknown
  Artificiall/Consensus sequence
atggaagttaaaaataaaaaatggttaaaatacattggtcagagtgctgttgttctccttttgatgggggctgtggtcggtctctatacgactgttcaaaaggatcaaaaacaaaatgaagcaaaaactgtacagacaacagaaaacaccaagctcaatattgcagttgtcaatgaagaccaagcggttaagctaaatggtaaagaatacaatcttggtgccagttatgtgaaaaatatcgagcgagataattcacaaagctggtctgtactgccacgtggagctgctgaatctggtcttgcagatggaaaataccaattgatgatcgttattccaagtgacttttcagagaaagttcttgaagtgaatgcagtcaacgcggaaaagactacagtcacttataaggtcaacgctgccggaaattcacaggttgaaaatgaagcaaataaagtagccaaggatattgtttcggacttgagaagccagttggtagatatgtatatggtcagcattttgagcaacctttatacagctcagaaaaatgtggagacgagtaacaaaattcagtcaacgaatattggttcttatcgtagcaatttgttggactcagctttggattcgaagaatattttcccgagtctctatagcttgtccacgtcatcggtggaatccaataatgccttaaagacggtactggaatcatatacgcaggcttttgatcaattgactcaatctcagaatcagtatggtcaaaattttgatgctcttgtaaaacaacgctctgaagataagattagttacgaagacttcatgaatcaactgatgtctatgaaccaatctgttctcagcgaaaatacgaaggaattatacaagaatcttcaactgaatcaagaaaatcttacgaagcaattaaaccaaccagttgagggtgatgcttcaggaacgaagacttatgcaggtttaaccaaagatgttaatgatcgtgttgcagatctagaaaaaggcataaaagcggagcgtcaaaagttagaagatcatgaaaagaacattgacacttctgtgaaagagaaactcttgggctactatggtctaaaggaaggagaaaaggttagccttcgaaccttattaggtaagtcaagtattgaagtgattagcaaggcacgtaaggctgctgatgaggagattcaaactgcgattgaagcacttccaggtttggatttaaaaagtttcgatctgaataagtatggaaatcttgatacagcgattgattttgatggaagttttgcagcttccctgggaactccaaaaggaagcgcagataatttgaagaaattagcgcaggaagtggatgccaaatcaaccgttatcgcgaacatcctcaatgcaaaagccgggaaacagaaggttagtattctagctccggcagggattaaaatagactcttggacctatgacggcaattcttacgctggtggagctgagcaggaagtgacgattcaggatgataaagaaatagccattcaattcagtgaagatggggctccaattccaagtccttcagagataaaaattattgtgaatggtgttgtttcaactaatgtaactgtatcagcagaagacttgaaaaaagctgtcgcaagttatgcaagtgaagcaagtaaaattgccttagcttatcagcatgcgcaaacgttgatgaatgcttactatccaaaagatagcaaaggagaacgtcattcaatctatgatccaattgaagatatcgatttgactgacgccttgactgatattgtgaagacagctgttgtaaacaatatcaaagattatcgcacaagcattgaaaaagatgaatcaggggacgaaactaagagtgtcaaagcacagctagatggtactctccaacgattgcaagatttaggtccacagttgcaacgtaaccttgaagagattgaaaatagtaacaacgagttgactaaaaacatcaatgatcaactgcaacaatatgcagatctccaaaaacgcttagagagcatctcgaatgctcaagaatcaagcaaccttgctcaaactaagacggacgtggacttgtcggctcttggttcggaatatacatcattgttgagctcaactgaaggggtaaagacctcttcgcgtagtaatgtagatgccgcaaattcaaccaatgaaatctttaaccaattgaacaaggaattacaacgagcgcaaggtaccacggagaaattgtctagtaatgcagagagtttgatgagtgaatttgataaggaattgtctgaaaatgggaacttcgtcgaagccttccgtaaagtcttcaacaatgcctatgaaaatggagtgccaaatgaagtcttgcttgacttcttgtcaaatccagttgcagagaaatcttcttctgtgaaagcgaccatcaatgtctaccgtccatttatctggatctttatgttggaagtcttgagcctctttacagcttatctctttgcgacgcaaccaattattcgtaaggtgaaagaccgtttcaaattggatcgtttgcaagaatcggatctcttaactgtcggtgtccttgtaggactttcccttatccttggacttgtgatcggaatgatttcaagtatccaactctctgttggtcgtgaatatgttccttcgtgggtgttactagcagtattggcgggatttgtattggtacaactgcaataccttctcttgaaacacttccgtgtgattggaatgggactggccttcttcatgttgatcagctatgtctacctatcaagcgcgatcggaacgactgcgaccttgtcgggccttccagcatttgtgaaaaatattaacctcctctctattctagaaggacagtttgcgggttactttgatggacaaacagctggatttaccgtcttctttggattgttggttttcttcggccttttgactgttgccaacatcttccttccaaagaagtttactcaaacaaaggaaattgaatcaatcttatga

SEQ ID NO: 2652 - DNA, 1359 bp, Unknown
  Artificiall/Consensus sequence
gtgtcacaagaagagcaattttggactcgttttttagaattagcccaattacaactaaaagatagtgcgtatgacttttttgtcgccgattcaaaattagttaaaatcgatggagagacagctaccatttatcttgatggtaattataaagaattattttgggaaacaaatctaaaaaacgctttgatcacagccagttttgaagtctacaatacagatttaaaattccagtttatttttgaagatctcgaagaacttcctaacagtcatagcagtgagaataggagactatcttcaggtagcttgacaaccgaaccgttgcctaaaattgatacaggtctgaaatcgaagtatacctttgataattttgtgcaaggagatggaaatatttgggctaaagcagcggcgcttgcagtttctgaaaatcttgcaacaacttacaaccctctctttatctatggtggaccagggcttggaaagactcacttactgaatgcaattggaaatcaaatcctagaaaatattcccaatgcacgggtcaagtatgtcccagcagaaacctttattaatgaatttttagagcaccttcgattaggagaaatgaagactttcaagaatacctatcgaagtcttgatcttttattaatcgatgatatccagtcacttggtgggaaaaaagtaaccactcaagaggaattctttaatacttttaatgccctccatagcgacaacaaacagattgttctaacaagcgatcgaagtccagatcatttagatagtctcgaagagcggttggttactcgtttcaaatggggattaacgcaaaatataacaccacctgattttgaaactcgaattgccatcttacggaataaaattgaagatctagactatatttttcctaatgacacactagaatatctagctggtcagtttgattcaaatgtccgagacttagaaggtgccttaaatgatatttctttaatggcgaaggtgaaaaaactaaaagaaattacgatcgatgttgcagctgaagctattcgagctcgtaaaaacgacagtagccagatgcttgtcatccccattgaaaaaattcaagaagctgtaggggctttctatggagtcagtgtaaaagaaatcaaaggttcgcgaagagttcagaatattgtcctagcacgacaagtggccatgtatctttcaagagagatgacggacaactcacttcctcgaatcggaaaagaatttggaggaaaagaccacacaactgtgattcatgcctatgaaaaaattaaaagtatggtagacacggatgataatctacgacttgaaatccaaagtatcaagaaaaaattaaattaa

SEQ ID NO: 2653 - DNA, 1242 bp, Unknown
  Artificiall/Consensus sequence
gtgaaaaaattctttctttcttttttaaccttcatcctacttttatgcagtctaccacctcaaaagatttttgcgaacgagccggatcttcctgttcaaagtgccatcgctgtcgaagcagacactggtaagatcttgtatgaaaaagattcggataaaaagcgagaagttggaggattgtctacactgctgaccacttatctaattttcgaagccattcatgacaaaaaactttcgttaaaagacccaatcaaattatccgaggaggcattggccttaaatgatattaaaggtgctggaactcttcccattgaggcaaaccaatatacggttgatcagttattgactgctcttttagttggaaattctagcactgccgccttcgccttagctgagaaagtgggtggctccgaaaaaagcttcgttgaaaaaatgaagcaaaaacttgctgaatggggcattcaatctcctcatttaattaatgctaccggattaaatactcaaaccatcagcggagatcctgacgggaaagaagacgaaaatcaattgagtgcttatgatattgctgttattgccaagcacttactccaggattttcctgaagtgaccaaatatacttcaaaacccactgctcttttttcaaacacgcagattgaaaaccccaacctaatgctagaagggatgccgaattaccgttctggagtcgacggccttcgagtcagcaactccaccaaaggaggaattacctttgctgcatcaacgacgcaaaatggtatccacatgatcacagttgtcttaggagttgaagcagttgacggtgatccttatgcacgctttgtagcaacttcatcactgatgaattacgtggtacgaacctttgtttcttccattgtcgtaaagaaaggagatacctatggaaaaagtaaggtcgccattacggatgggaagtttgagtccgtttcggctgttgccaaaaaagacttctatgtcgtggtaaaacaaggcaatcaaactgaacctaagatccaattcaaaagtagtcaaaaccaattcaaagcccctgtaaaatctggagatgatgttggaattctccaatactcagatccaaataaaatcgggcgaggctacttagaagatcaagagccgacagtcgatatggtagcaggaaaaaccgttgagaaaagctttttcttaaaggtttggtggaatcaattcgtccgttatgtcaacgaaaaattataa

SEQ ID NO: 2654 - DNA, 2826 bp, Unknown
  Artificiall/Consensus sequence
atggtcttacaaaaattagagaactttagaaataaagacattgtcaaagaagaagccgaaattctaacagatctattggatgatattactaaaaatcttgtttgtccggagacatttgaaaaaatttcacaattaaaggatctatcgaaaacaaagaattaccgtgacttgaaccaattagtagaacaattgtctaatgaagaaatgacggtaatctcacgctattttgcgattttaccactgttgatcaacatctctgaagatgtcgatttagcttatgaaatcaatcatcttaataatgtggatggcgattatcttgggaaactttcttcaacgattaaagaagttgcaaaaaatgaagatgcacaagaaattttagaaaatctaaatattgtacccgttttaacggcccatccgactcaagtgcaaagaaagaccatgctggatttgaccaatcatattcatgctttacttcgccaacatcgggatgttaaagcaggattgatcaatgagaataagtggtataataaccttcgttgtaatattgaaatcatgatgcaaacggatatgatccgtgataaaaaattgaaggtgacaaatgagatcaccaacgtcatggagtattacaatagttccttcttacaagctgttccaaacctcgtgttggaatacaaacgtttagcaaaagaacatggtttagagctcgaacaaccacatccaattacaatgggaatgtggattggaggagacagggatggaaatccttttgtgacggctgatactttaaaacgttcagcaaccattcaaagtgaagtcattttgaactattacattgaaaagatttctaaattataccgtcatttctcactttcaactagtctctctaatactagtgaagcggtagctgagatggctgccttgtcaagtgatacgtcagtctttcgcgaaaaagaaccttaccgtcgtgctttccactatatccaatcaaaattgatccaaaccttggttaacttaaaagaatggactatggttggtgaaacaagggaagaccgctatgcggtagagagattattgggagcaagtaatcaccaacaagggcccgtttctgattatattgataatcggatttcaggcgccttaaaagagatttctgctaaagaatctccagcttatgcgtccgctcaagagtttaaagaagatcttgaaaagattaaagattccttgttagaaaataaatcagagtatttgatttccggtgagtttgcagaactcctagaagctatcgatgtctttggtttttaccttgcatctattgatatgcgccaagattctagtgtgcatgaagcctgtgtggcagaattgctgaaatcagcagggattaatgatcattattcagatttatcagaggacgaaaagtgtcagattctcttgaaagaactcttagaagacccacgtattttatcagcaacccatgccgataaatctgagttgcttgaaaaagaattggcgattttccagacagcgcgtgaattgaaggatcgcttgggtgaagaagttatccgtcaaaacattatctcccatgcaacaagcgtatcagatatgttggaactggcagtgatgttaaaagaagtgggcttaattgatactgaaaaagcacgtgtgcaaattgttccattgtttgaaacaattgaagatttggatcattcagaagaaaccatgagaagctacttgtcacttccaatcgctaaacgttggattgcttctaagaataattaccaagaaattatgttaggttactctgattccaataaagacggtggttatttgtcttcttgttggaccctctttaaagctcaacaacaattgaccgcaattggagatgagtttggagtgaagatcactttcttccatggccgtggtggtaccgttggccgtggtggaggtcctacttatgaagccatcacgtctcaaccattgaaatcgattaatgaccgaattcgcttaactgagcaaggggaagtaatcggaaataaatatggaaataaagatgccgcttattacaaccttgagatgctcgtctctgcaaccattaaccgaatgattgccgaacaaaagagtccattctctatgttcgatcgtttcggggaagtcatggataaagtcgtgaatcgtagttatgatatctatcgtgatttggtctttggaaatgagcacttctatgactacttctttgaatcaagtccgatcaaggctatttctagctttaatattggttcgcgtccagctgctcgtaagaccattacagaaattggtggtttacgtgccatcccatgggtcttctcttggtcacaaagtcgtgtgatgttccctggttggtacggagtaggttctagctttaaggaatttatcgatgaggatcctgagaatatcgaaacccttcgatacatgtataaaaactggcctttcttccaatctctcttgtcaaatgtggacatggtcttatcaaaagccaatatggatattgcctttgagtacgcgcaattgtgtgaagaagaagaagtgcgcaatatttatcaaattatcttacatgaatggcaattgacgaaggatattatcttgatgattgaggaacaagaagaattactcgcggaaaactcttatttgaaagaaagtttggactatcggatgccatactttaacgtcttgaactatattcagttagaattgattcgacgtcaacggactggacaactaccagccgatcaagacaagctgatccatatcaccatcaatggggttgctacaggactacggaattcaggctaa

SEQ ID NO: 2655 - DNA, 1350 bp, Unknown
  Artificiall/Consensus sequence
atgaaatttgtgaaacaatttgaaaataaaaaggttcttgtattaggtttggccaagtcaggcgagtcagctgcccgtttgttggagcgcttaggagcgattgtgaccgtcaatgatggcaaaccttttgaagaaaatccagcagcacaaagtttactggaagaagggattaaagttgtgacaggaggccaccctctggagttgttggatgaagactttgcggtcatggtcaaaaatccaggaatcccttatacgaatccgatggtcgaaaaagcgcttgaaaaaggcattccagtcctcactgaagtagaattggcttatctgatttcggatgcgccaattattgggattacaggatcaaacggaaaaacgacgacgacaaccatgatcggggaagtcttgacggctgctggtcaaggtagtctattgtctgggaatattggttttccagccagtcaagtcgcacaaacagcgacagaaaaggaagttctggtcatggaattatcttctttccaattgatgggaattgaagccttccatccagagattgcagtgattaccaacctcatgccaacccatatcgattatcatggttcttttgaaaattatgtagctgctaaatggaatcttcaaaagaatatgacagaaaaagatgtcattgtattgaacttcaatcaagacttggctaaggaactcgctacaaaaaccaaggcaagggtccttccattttctacaatcgaaaaggtggacggtgcttatttggaagatggacttctcaagtttaagggagaagttgttatgcgagcagatgaactgggggttccaggtagccacaatgtagaaaatgccttggcaacgatagctgttgcaaaagtccggggtgtagagaatgaggtcattaaagaaaccttgtcggcctttggaggtgtgaaacaccgtcttcaatatgtggatgaaattcaaggtgtcaaattctataatgatagtaaatcgaccaatattttagcaacacaaaaagctctttctggttttgataacaacaaggtgatcttgattgcaggggggctcgatcgtggcaatgaatttgatgaattggtgcctcacattactggcctaaaggaaatggtgattctaggggaatcggcccctcgagtgaaacgcgcagccgataaagcaggcgtcccttatgtcgatgcggcagatgtagcagatgctacaaagaaagcctttgacttggctagccctggggatgttgtgctactaagtcctgctaatgccagctgggatatgtatccgaattttgaagtgcgtggggatgaattccttgctacagtaaaagggttgaaataa

SEQ ID NO: 2656 - DNA, 1035 bp, Unknown
  Artificiall/Consensus sequence
atgcaagcaattaccgacactaaacatctgacggtcaaaactctgcctcctattcttgtcttgacaggagaggatgtaggtcaatttgaatggttaaaaaaagatattttaaataaaataggctatgatccttcagatttgaattattcttattttgatatgaaggaagcctcctatgatgaggtcgagctggatttggtcagtcttcccttttttgcagatgaaaaaatcgtgattttggatcacttattggatgtgaccactgccaaaaaacgcaatttaacagatgaagatctaaagcaatttgaaaactatctggaaaattcttctgaatcgacccgtttggtgatatttgcagaaggaaaattagatagtaagcgccgcttggtcaaactcctaaaacgggatgcccaaatcattgaagcgacaacgcctaaagagcaagaagtaaaacgttattttgcaagtcaggcccaagaattgggcttgcagtttgagggcgattccttggaccagctactcttaaaatctggctatgattttggagagttacagaagaatatcgctctactgcaggcttataaagaagatggtcagattaccctcgaagatatcgaggaggttgttccaaagtccttgcaagataatatttttgatctgacacaaatgattctcaaacgccaaatcgatcaagcccggaatttggtgaaggatctccgcttacaaggagaagatgagataaaattgatcgctattctgttggggcaattccgaatgttttctcaagttaaaattttctcagaagaaggccaatccgaaagccaaattgtagcgagcttgtcggagttgtcaggacgcaaggtcaatccttaccaggtgaagtttgccttacgggatagccgcaggctttccctgtcctttttgaagcaggctatgatgactttcatcgagacggattttgcgattaaaagtggaacatatgaaaaagactacttatttgatttggccctgttgaaagtagcgaatagcgtctaa

SEQ ID NO: 2657 - DNA, 3537 bp, Unknown
  Artificiall/Consensus sequence
atgtatctaaaagagattgaaatccaaggctttaaatcctttgcggataagaccaaggtcgtgtttgacaaaggagtcactgctgttgtagggcctaatggatctggaaaatcaaatatcacggagagcttgcgctgggccctgggggaatccagtgtcaagagtctacgtgggggcaagatgcccgatgtcatctttgcagggacagaatcgcgaaaaccgctgaattatgcctgtgtcacagttatcttagataaccaagatggttttatccagcaggcagggaaagaaattcgtgtcgaacggcatatttatcgttcaggagacagcgagtacaagatcgacggcaagaaagtacgtctcagagatgtgcatgatttgttcatggatacgggattgggacgggattccttctccattatctcccaaggacgggtagaggagatctttaactccaaaccggaagaacgccgggctatctttgaagaagctgctggtgtcttgaaatttaagacgcggcgtaaggaaaccgagaccaaactcaaccaaacccaggagaatttggaccgtctggaagacatcatctatgaattagaaggacaaatccaacctcttgaaaagcaagcggctgtcgctcgtcgtttcttggaattagaccaagaacggcaggttctcttgctagatgttttggtcgctcaagtcgatctgacaaaagagctctacgaaaaggctgatcaagaagaaaaggccattcaagaacagttggcttcttattaccaacgtcgtcaggtcttagaagaagataatgtacgcatcaagaaagcccgccatcagttggatgaaagcttagctgaagatcaggccagtttgctagaggtcactcgattgatcagtgatttggaaaagcaaatcgaagtagctaagttgcaatcgagtcaagcagcccatagtcgcagggaaaatcttgagcggctggatgctgttttggcccgtctggaagaagcgaaacaagagctggctcaaaaacaagagacgctagctgtgcttcaacaaaggctgacagagaaccggcagcaacaagaagagttggaaaaagaattagccaactacgaagaagatccggaacaagtcattgagcatctacgcgagcagtatgtcgcgctcttgcagacggaggctgaaaaatcgaatgagcggacagctattgagagccggatccaagcactattgcaagaatcaagccatcgtcaagaggatttgaccaaggcacaaacaaactttgaaactgccaaggaaaaagaagtccgacaattggaagagttggatcaggcacaagcgacggtcaaaggtttactagtagaatatcaagagcaattggtaaaagtggagcaggccaaagctgcctaccaagaggctcaagaggccatgtttgacttgatggatgagagcaaaaacaaacgggcgcggatcaatagcttggaagccattcagaagaaccatagtaacttctatgcaggcgtcaagagcgttttgcaagaagcagaacggttaggaggcatctgtggggctgttagtgagaatttgagtttctcaaaagactaccagacggcgcttgaaattgctctgggagctagcagccaacagatcattgtcgaggatgaaaaggctgcaacgcgagcgattgatttcttgaaacgcaatcgcttgggacgggcaacctttcttccgctaacgacgatcaaagcccgtcaactatcccctcggaatctggagctgattcaaaccagtgcaggatttttaggaattgcgagtgacttagtgacctatgagcatcgttttgaacagatttcccaaaacttgcttggagtaacggccatctttgacacgacggagcatgcgcgtgaggcggctcgtacagtcaattatcaagttcggatggtgaccttggatgggaccgaattgcggaccggaggatcgtatgccggtggtgccaatcgttcccaaaatacggtctttgtcaaaccagaattggatagtttgaagcaggaaatgcaagctctggatgctcgtttgagagaagcagagcaggaggtagagacaaaggacaatctgctcaagcaggcgcaagaatacctagcctccattcaaagccagggtgagcaagcgcgtctagagcaacagcgggcccaattggcctaccaacaaagccaagagcaactgaaagaaattcaggaactcttagaagctttgaagtcagaattggcaacagatgcgacccagtctctccaagaagagctggagtcccttactgagcaattggcagaaattgagcttcaaaaagaaaacttaaatcgcgatattgaaaccatgaagtccgataaagatgttctgcaacaaaaagtgcaatacttgcaagagcaattggcagaattgcgacttcaacagacggaatataagagccaacaaagctacgaacaaacagatgctcgtcgcttggaagaaacgatctcccagttggaagtagaagagcatcagttgcaattgctgattgaacaaggcgaggcccaagttcagacagtcgatgtggagcagctagccaatcaattggcactggcccaagctaagaaaacggacttggaacaaggagttattcggaaacgctttgagctggatgatttggaaggccaggccgaagatgttgcagaacagatggaacaagctcgcaagaaaaacgaagagtggattcgtcaacaagccaaggctgaagcgacgcgtgaaaagcatgcggatcgtttgaacaagcttttaacgcaaattaccgatgaattcatgcaaagctttgaccaagccaaagagcaggccaaacctgttgaaaatcttgcggcagctgaaaaccagctcaagagcatcgaaaaagatattaaggcacttggtccagtcaatgtggatgcgatcgggcagtatgacgaggtgaagggacgctttgatttcctttcgagccagcgtgaggatgtcttggctgcgaaaaatatgctactgtctactatcaacgacatgaatgacgaagtcaaggaacgctttaaatcaacttttgaagccattcgtgaatcctttaaagttactttccgtcaaatgtttggtgggggttctgctgatttgattctgacagagccagatcttctgacagctggtgttgagatttctgtgcagccacctggtaaaaaaatccaatccttaaacctcatgagtggtggagaaaaggccttgtctgccttggctctcttgttctcgattattcgtgtcaagactattccatttgtcattttggatgaggtagaggctgccctagatgaggccaatgtcaagcgctttggggattatttaaaccgctttgataaggaaagccagtttattgtcgtgacgcaccggaagggaactatgtcggctgcagattccatctatggtgtgaccatgcaagaatctggggtttctaaaatcgtctcagtaaaattgaaagacttagaaaatgaagaataa

SEQ ID NO: 2658 - DNA, 1311 bp, Unknown
  Artificiall/Consensus sequence
atgattagtcaaattgtgatgattattgccctggtttcgatttggttatctttagcctggggactggtgattctcttctcagccgttcatttttggttcaaacatagtgattttcgtgtcaatacggatccccttccgtattaccctaaagtgaccattgttgtaccagctcataacgaggatgtggtcattgctcaaacagccaaagcgattcttgacatgaactatccacatgatcgtgtcgaattattgctgtttgcagataattgttcggataggacctatgaagagtgtctttcagtccaagcattgccagagtacgcaggacgcgatttaacaattattaatcgaagcggaacaggtggaaaagctggtgtacttaatgatgctttgaagatggctacaggagactatatctgtgtttacgatgcagatgctatgcctgaaaagaatgcgctttattttttagtgaaggaagtacttaaagatccggaacgtcatgtggcctcctttggtcgaaataagacgcgaaatgcagggcaaaattttttaacacattgtatcaatcaagaaattgtcgtcacccaacgggttcaccatgtcggtatgtggcatctctttaagattggacgtattccagggacaaactttattatccaaaccgaatttgtaaagagtattggaggctggaaaaatggtgccttgacagaggatacggatatctcctttaagattatgcaaagtgggaagttgattgctctcgcgtataattcagaagcttttcaacaggaaccagaaactctgaagagttattatatgcaacgtaagcgttgggcaaaaggaaattatgaggtagttctttccaactttaaacatctatttggaaaaggaaattggcgtgtgaagttggaagttattaattactcctgcatctttttctggtttaatgcagcgatcattttatcagatttgatttttttcgcaaacattttagctatctgtatccattcagtcgtcccaggagttcaaataccatttgcctttgattctgataatatttatattgctcaattaatgttgtttaattggattttgatgattggaatttatcttcttcagatcaatgttgcactagcatcgcagtttggtcaggcaacgatcaaacaaatttggttagccctggccgcgtatttcacctattcacaactgtttattattgtatctgttgatgctgtttcttctattgtgatggataaactgttgcatcgtgagggaacaaaatgggttaaaacaaaacgattcgcggggtag

SEQ ID NO: 2659 - DNA, 1182 bp, Unknown
  Artificiall/Consensus sequence
atggatttaacgaaacgctttaataagaatctaaatcggattgaagtttctttgattcgtcagtttgaccaatcaatttcttccattcctggtgtcttgcgtttgactttgggggaaccggattttacaactcctgaacatgtgaaagaagctggaaaggctgctattgacgcgaactttagtcattatacaggaatgagtggcttgctggctttgcgtgaggctgcgagtcagtttgtggctgataaatatggtatttactatcgtcctgaggatgagatattggtgacgatcggtgcgactgaagccctgtctgcaactttgacagcaatcttggaacctggagatgtagtattactcccagcaccggcctaccctggttatgaacccattgtgaatttggttggggcggagattgtcgaaattgatacgacagcagatcgttttgtcttgactcctgaaaagttggaaaaggcgattctagagcagggtgaaaaattgaaggctgttattctcaattatccagctaacccaacgggtgttacttattcgcgcgaacagatggcggaattggctgctgtcttaaaaaaatatgaagtctttgtgatttgtgatgaagtctattcagagttgacttatactggagaagcgcatgtctctatggcatccttcattcctgagcagaccattgtcattaatggcttatctaagtctcatgccatgacaggctggcgccttggctttatctttgccccagctgcattgacggcccaacttatcaagagtcatcagtatttggtaacagctgctggaactatgaatcagtatgctgcgatcgaagctttgacggaaggtcgggatgatgcggagccaatgaagaaggaatatgtgaagcgtcgtgattatattattgaaaaaatgtccgcgcttgggtttgagattattaagccagatggagctttctatatttttgctaaaatcccagctggttacaatcaagattcctttgctttcttgcaggattttgcgcgtgaaaaagcggttgcttttattcctggtgctgcttttggtcaatatggtgaaggttatgtgcgtttgtcgtatgcagccagcatggaggttatcaaggaagctatgaaacgcttgaaggagtatatggaagaacatgctggagtcaattga

SEQ ID NO: 2660 - DNA, 3099 bp, Unknown
  Artificiall/Consensus sequence
atggcaaaattaattcctgggaaggttcgttcacaagggagccttctctatgaagctgggaaagtttcccttcaggaagtaaaagaaaaatacctatattttcgggtggaagaagaaagcttgcgttacagtttggatgacgatgccgttttttgtagctgtgctttctttcaaaagaaaaaattctgtacgcatctggcagctgtggaagcttttttgaagaatgatgacagtgggaaagcagctcttgcaagtcttgaagaagatgccactgtgacagaggaaactcaggagaaggtatcttttggaagtttgtttttagaccaggtccttccaaaaatcgaaaagaaagaaacccgctatgtcttatcagccgttgggcaggaggatgaatactctggtcaattcttgtggactcttcgcattcgtcgcttgccagacgagcgctcttatgtgatcagagatgtgctagcttttttgcagacccttcagaaagaaggacactttgcaattggcaaaagttattatgaacccatttcttacttagaatttgatgaggctagtcaggatgtgatcaatttcctacaaggcttggtcacagatggtggatcgaaagagcaagatttctttcccaatgctgggcgccatctttattttccaccgactctctttgaagaagctgtggaattactgatgaatttggattccttcctcttccaatatagcttgtatgattttcaagaagtccattttcaggatgtccatggggaggaagatctctttcattttcaggtggaagaccatggtgatttttacgaattgatcattactgagccacaagtgaaggtagttgagtctgctgtttacctgtttcgaaatggtgtcttctatcacctgacgccccaacagcggaccctatggaaggccatccaagatcttccgatggatcaggatcgcaaaaaacgcctgcattttgatccaacggaccaaacaaagctttcctatagtttaaaagagttcaaaaaactggggaaaataacagctccgaccagctttttaatccacgatttcactccggaatttcattttgatttggcgcaggaccagaccgttttactggacgtggtctttcaataccaggatcgtgcggtgaccacgcgtgaggaactcctcaatcttccttattccagtaatttcgataaggagcaagaagtcttttcaaccatgctagcagcaggttttacagacgacttttcttcccaaagaagtcctttatcaagtgagcaaatctatccattctttcaccaacagatcccgacttttgaaaccttaggagaggttaccctctctgatagccttttagatctttatcaagtggagcgtccaaaaattgatgttaaaaccaatggcagtctactggagattggttttgactttgaaagtgtggatccagctgaagtggaccaggttctcaaagctttggtggggcaagaagattattttgtcagctatacagggaaggtccttgtttttgatgaagaaaccaagaagatcagtcgggccttagcggatttgcgggcgaaaatgagcaagggtgggaaactacaagcccgccggattgctgcttatcagctatctgatttgttggcagatcaagacaatgttcatttttcagaagaatttcgaaatttggctcatgatctgactcatccagaagattaccacctccctcagatgccaatccaagcgaccctgagggattaccaagaaataggggtcagatggttctccatgctaaatcattatggttttggcggtattttagcggatgatatggggcttgggaaaaccctgcagactatttcatttttaacgagtgtctctaaaactgaaactaaaatcttgattctagcaccgtccagtctcatctacaactggaaagaagaattttcaaaattcgctcctcagatggaagtggcagtcgtctacggcctcaagcaacaccgagatgaactcatcgcaaccaatccacaggtggttatcactagttacgcttctttccgtcaagatgtggaggaataccagaagaatcagtatgagtacttgattctagatgaagcccaggtcatgaaaaatgcccaaaccaagattgcccaacacttacgtggctttgaggttccgcatgtgtttgccctatctgggacaccgattgaaaatcatgtgggagaactctggtctatttttcaaattgtacttccagggctgttcccggctaaaaaagaatttcaaaaattgagtcctgagaccattgcgcgatttgtcaaacctttcgtcatgagacggaaaaaagatgaagtgctccaagaattaccggacttgattgaaacaacctaccacaatgagttggatgaaagccaaaaaacgatctatttggctcaattaaaacaaattcaagatcgggttcgaagctctagtgaggaagaaataaatcggagcaaggtggaaattctctctggtctcatgcgccttcgccaaatctgtgatacccccgccctctttatggaagactatcagggagatagtgggaaattggagagccttcgagatcttttggggcaaatcaaggatggcgaccatcgggttttgatcttctcccaatttagaggcatgttggatatcctagagcaggaaattgaccagcttggcatgacctcctttaaaatcacgggttccactccggccaaggatcgtcaagaaatgaccaatgcctttaatgcaggtgagcgccatgcttttctcatttctctgaaggctggaggggtcggattaaacctcactggtgccgatacggtcatcttagtcgatttgtggtggaatcctgcagtggaagaccaggctattggacgtgcccatcgaatgggacaggaacaaaatgttgaagtttaccgcatgattactcgtggtacgattgaagagaaaatccaagaactgcaagcttccaaaagacacttggtctcaacgattttagatggaacggaaacacgatccagtttatcggttgaggaaattcgtgagattcttggaattccgtcagaatag

SEQ ID NO: 2661 - DNA, 1182 bp, Unknown
  Artificiall/Consensus sequence
atgaaatcttcatctaatttactgaaaaaagttgggaacatagccctcatttttgttgtaggttttctaggtgggattcttggaacctttttaaccttaaaaacatctcattcttctacttcaaatactgaaagtaagcaagtccactcaaccactgttaaaacagcttataaaaacacaacctcaactagtgaggccgtcgataaggtgaaaaatgctgtagtttctgtgattacttattctgattcttcgaatcaaggagtgtttgaaaaagaagaaaaccctgactcacaaatttctagtgaaggttctggggtcatttataaaaaagaaggaaaatatgcctaccttgttaccaatacccatgtgatcaatggtgctaaaaaagtagatattcttttagcagatggtaataaagtccctggagaagtagttgggtcagatgtctattctgatattgcagtagttcgaattagtgcggataaagcaaaggcagtagctgaattcggagattcaaaccaattaacggtcggtgagactgcaattgcaattggcagccctcttggaacagattatgctaattctgttacccaagggattatttccagccaaggtcgcaatgtgaaattgaaagccgataatggacaaaatatctctacacgcgctctacaaacagacgcagccatcaacccaggaaactctggaggtccattaatcaatattcaaggacaagtcatcgggattacctcaagtaaaatttcaaataacggacaaacttcagtagaaggaatgggatttgcaattcctgcaaatgatgttgtcaatattatcaagcaactagaagaaaaaggaaaagtagttcgaccagctcttggaatccaaatgatggatttatccaacctttcaacttctgatttaagccaattaaaactacctgaaaaaatctctggaggagtactggttcgttcaacacttgaaaatatgcctgcttcagataaattgcaacgctacgatgtgatcacaaagatcgacgatacagatatcgagtcaactgcagatttacaatctgccctctattctcaccaaatcaatgatacgatcaaggtcacattctatcgtgatggaaaacaacaaacaacttctatcaagttaacaaaatcaactgaggatcttagtgagtaa

SEQ ID NO: 2662 - DNA, 1275 bp, Unknown
  Artificiall/Consensus sequence
ttgaaaattaaagaaaaatactatgaatcagtaggcgagcaggtctactttacacacttgtcaaacggattgaccattcatttaatcccaaaagaagattattatgaaacctatggaatgatcacaaccaaatttggttcagtggacacacgaattctagtgaatggtgatgaaagacaatatcctgcaggaattgctcattttctagaacacaaagtatttgaagatgaaaaaggtcaagattatctaacaaaatttgttcatttaggatcggaaagtaatgcctttacaagctttacaaagacaagttatcttttctcaacaacttcaaaagtccctgaaaatattcaattgttattggagatggtttcaaaggcttcctttacagaaaaatctgtatctaaggaaagagaaatcattcaacaagagattggaatgtaccaagatagtccagactatcgattgttttttggtgctttagaaaatttatatcctggaacaccgttagcagatgatattgctgggacaagagactcaatttctgatattacaatcgataatctccatgaaaattttgatctattctatcatccctctcaaatgcacttattagtgataggaaaattcgatgttgatccgatattacaagttttaaaagaatatgatcaaatttcccaacttccttcgatcaagatggaacgttttcctgtagaaaaaaacgaagtgaaactgaatcaatcctgcagaatggatgtggcgactcctaaattggcaattggaattcggggaaatgatgacattaaagaagaggaaaaatttcgctataaattaatgttaaaattactattttcgatgatgtttggttggacttcgcaacggtttcaaagtttatatgaagcagggaagattgacaactcattgacactcgaagtggaggttgaagaattatttcattttgttattttgacaatggataccaaagaaccagtctccttatctcatcaatttaggtcagctatcaaacaatttgataaggatccagatgtgaatcaggaacatttggatacgattaaaagcgaaatgtttggtgatttcttacaaggtttaaattcgcttgagtatagtgcaactcagtttgattatttttcagacggtagcacatcttatgatcttccaaagattttacaaagtattagtttacaagatatcatcaaattaggtcataaattcattgatcaggctgagatggttgactatatgatttttcaaaagtag

SEQ ID NO: 2663 - DNA, 1035 bp, Unknown
  Artificiall/Consensus sequence
atgcgcttgcgcataggtaggtcagtttttagaaaagagatttttcaatctatgttaaatgaatttcctattttcgactatgaagatattcagttgattcccaacaaatgtatcatcaatagccggtcagaagcagatacaaccgtccaatttggaaagcataccttcaagcttccagtcgttcctgccaatatgcagacaatcttggatgagaatgtagcagagcagttggcgcgtggtggttacttctacatcatgcaccgttttgatgaagcgggtcggattccttttgtcaaacgcatgcatgatcaaggtttgatcgcttccatttcggtcggtgttaaggaatacgaatacgactttgtgagtcaattaaaggcagatgctcctgagtacatcactattgatatcgcacacggtcatgcggatagtgtcattcgaatgattcaacacatcaagaaagaattgccagatacatttgttattgctggaaatgttggaacacctgaagctgttcgtgaattagaaaatgcgggagcggatgcgactaaggtcggaatcggccctggtaaggtttgtatcaccaaagttaagactggatttggtacaggtggttggcaattggctgctcttcgctggtgttcaaaagcagcgcgtaagccaatcattgcggacggtggaattcgaacccatggtgatattgccaaatcgattcgtttcggggcgtctatggtcatgatcggttctctctttgcaggccatatcgaaagtcctggtaaaacagtagagattgatggggagtctttcaaagaatactatggatctgcttccgagtaccaaaaaggcgcttataagaacgtagaaggtaagaagattttattgcctgccaagggtcatttgcaagacaccttaacggaaatggaacaagatttgcaaagttcgatctcttatgcaggaggccgaaaattagcagatttgaaacatgttgactatgtgatcgttaagaattctatctggaatggcgatgcacactaa

SEQ ID NO: 2664 - DNA, 975 bp, Unknown
  Artificiall/Consensus sequence
atggatatttacgtaaaaaaagccatcattcatcaatttagcccagacgataccgatctctatctggcagataaatttctcaatatcacacctaaaatcgaggaatacttgcgtaagaagattgaacgggtctactcggatgaagccaggactggtattttcgaagaggacaatccttttcttgagatgatctcagatgacctattagaaacttcggtcgtagtagcgaatcgctggaaggaagaatttgtcgtctctgagaatcaaaaaaccaacgatttggtttttgttgagttttcaaaagaaggggtggaccattttgcttttcttcggattgccttacgggaaaccctgacgcatcttggtggtgaagttgacaatccgattaagttgacgcaaaataatctacctggttttgggactggtgcagatgaagctttggtcatcaatcttcaaagccgcaaataccacttgattgaaaaacgaatcaagtacaatgggactttcttgaactatttttctgagaatctgttgcaggcgcaacccaagatctctcctaaaaaatcgatcaaggcactagaaaaaacagcacagaagattgcggaaagctttaacacagatgattttcaatttcaatcaaaggttaaatcagctatttttaaccatattgaggaagaaaataaactctctcctgagaaattagcggatgatctcttcgacgacaatctgacagctcgccttagttttattgaccaagttaaagaagctgtaccagagcccgtcacctttgaagagattgattcaagtcgccagttgaagaagttcgaaaatcagaaattgtcattgtcaaatggaattgaactgatcgttccgaataatgtctatgaagatgcagaatctgttgaatttattctaaacgagaacgggacctattctattttgatcaaaaatattgaggatatacagagtaaataa

SEQ ID NO: 2665 - DNA, 2031 bp, Unknown
  Artificiall/Consensus sequence
atgtcatttatagacgagaaagaaattgcagctgctatgtctgtcaaacttgactttgatgtcctacctgaaaaggcgacttttcaagaaggaatccgtcgtgcacctgatagaggcttccgcttaacgcaagctcagactgaaattgcccttaaaaatgctttgcgttacattcctaaaaaattccaccaagagttgatcccagaatttctggaagaactaaaaactcgtggtcggatctatggctatcgattccgtccaaaagatcgcatctatggaaaaccaatcgatgagtacaaaggaaaatgcaccgctgctaaggctatgcaggtcatgattgacaacaacttgagctttgaaattgctctttatccatatgaattggtcacttatggggaaacaggatctgtctgtgccaactggatgcaatacaacttgatcaagaaatacttggaagtcatgacagaagaccaaaccttggtggttgaatcgggtcaccctctgggtctcttcaaatcgaaaccagaagctcctcgtgtcgtcattaccaacggtctcttgatcggtgagtatgacaacatgcgcgactgggaaattgctgaagaaatgggagtgacgaactacggtcagatgacggctggtggctggatgtacattggtcctcaagggatcgttcacggtactttcaacacccttctcaatgccggtcgtctcaaacttggtgtgcctgatgacggcgacttgaccggtaaactcttcatctcgtctggtctcggtggtatgagtggagctcaagggaaagcagctgaaattgcaaaagcggttgccatcgttgcagaagtagaccgctctcggatcgaaacccgtcactctcaaggttggattagtcaagtaaccgacagtgccgaagaagctgtgaaattggctcaagcagcactggaagctggtgaatcaacttcgattgcctaccatggtaatatcgtagacttactcgaatatgtcaacgaacaccaagtccatgttcatcttttgtctgaccagacctcttgccacaacgtttatgatggtggctattgcccagttggcattagttttgaagaacggacacgtttgctggcagaagacaaagaaaccttccatcgcctggttgatgaaaccttggctcgtcactttgcagtgattaaagctttgacggctaaaggtacttacttcttcgactacggtaatgccttcatgaaatctgtttacgactcaggcatcaaggaaatttctaagaatggcttggatgacaaggacggcttcatttggccatcttatgtagaagatatcatgggacctatgctctttgactatggatacggtccattccgttgggtctgcctcagcggtaaacacgaagacttgattgcaactgaccatgcagcgatggaagcgatcgatccaactcgtcgctaccaagaccgcgataactacaactggattcgcgatgctgaaaagaaccaattagtcgttggtacacaggctcgtatcctctatcaagattgtatgggccgtgtcaacattgcattgaaattcaatgaactcattcgccaaggcaagatcggacctgtcatgattggacgtgaccaccatgacgtatctggtacagatgctccattccgtgaaacatccaatatcaaagatggttcaaacgttacctgtgatatggccgttcaatgttacgctggtaacgctgctcgcggtatgagtctcgtcgctctccacaatggtggtggtactggtatcggtaaagctatcaacggtggatttggtctcgtcctagacggtagccaccggatcgacgaaatcatcaaatctgccattgcctgggataccatgggcggagttgctcgtcggaactgggcacggaataaccatgccattgaaacagcgatcgagtacaaccgtctccatgcaggaacagaccacatcaccattccttatctggcagatgaagatttggtcaaagaagccgttcaaaaattgttttaa

SEQ ID NO: 2666 - DNA, 2544 bp, Unknown
  Artificiall/Consensus sequence
ttgaaaacaaagggcctaatctgctataatatagggaacaaggagaaagaatcagtgaatcaattaaaagagaagttgcaagatttttggaagaaagtccaaaaattctttgcaaatatgtatacagaaactccaaataaggaaaaaaaagaagagagcagttggtctattggtgatatttttgcgacctctttacggaccctcaaactcttgtgggatgtcatgattgccctttctatttgcctctttttatttggtgcagggatcgggattggttatgctgcgagtctctttaacaatgttaaggctccgaagacagaggaattggtccagcaggtgcgtaatgttagtagcgtttcaaaactgacctattctgataagagtttgatttcagaagtagacagtgatttgatccgcacaccagtagctggagatgctatttcagacaatgtcaaaaaggctgtgattgctactgaggatgagaattttgaaagccacaagggggttgtgcccaaagccgttcttcgggcgacgcttggatctgtagccggcgttggctcctctagtgggggatcgaccttgacccagcagttgatcaaacagcaagtcgtcggagacgctccgacctttactcgtaaggcgacagaaattgtcgacgcccttgccttagagcgagggatggataaaaacgaaatcctgaccacttacttaaatgtttcaccttttggacgaaacaatcgtggacaaaacattgcgggtgtggaagctgcggctcaagggatctttggagtctctgcgaaagacctgtccgttccacaagcggcctttatcgcagggctgccacaaagtccgattgtctactccccttatgctgcagacggtagcctaaagagtaaggaaaatctagagttaggtttggcgcgtgccaaagacgtcttgttcaatatgtacaggacaggagtcttatcgaaaaaagactacgaaacctatgctcagtatgatttgaccaaagacttcatcgcttcggatggcatcgagaaaacgccacatgactacctctatttccaagccatgaaagaggcgaaagaggccatgtatgattacttgatcaaacgagacaatgtgaccaagcaagacttgaaaaataatgagacggttaagtcttatcaaaaattagctgaaagtgagttgcgtgaaggtggctacaccattcaaacaaccattaacaaaccggttcacaatgcgatgcaggctgcagtggcgaattttggaaacatcttggatgatggaacgggacttgtagaagttgggaatgtcctcatggacaatcgaaccggtgcgattttaggttttatcggtggacgtaattttgatggcaaccaaaacaaccatgcctttgatactgaacgttcaccagggtcgactatcaaaccgctgttggcctatgggattgccattgaccaaggcttgatgggaagcaatagtatcctttctaactacccaactaatttctcaagtggcgaaccgatcatgcacgtagataaccgaggaacggccatgatggatcttcgtgaggctctcaatacttcatggaatatcccagcctattggacctaccgaaccctacgtgaaaaaggggtggatgttccctcttacatgaagaagatgggctatgatatctctgaatacggaattgagagtctgccgatgggtgggggcattgaggtcactgttgctcaacataccaatggttaccagaccatagccaataatggaaactacctcaagcgttacatggtagagcaaattattgatcgggatggggatgtggtctacaagcatgaagcagatcctgttcgtgtctactctccagcaacggcaacgattatgcaagatctcttacgtggagtgctcacatctggggcaaccacaaccttcaaatcacggcttagtcaagtcaatccaacgctggctggtgctgactggattggaaaaactggtaccactaattcaaatggggatatgtggttgatgttgtccacgccaactgtctctctaggagggtggattggtcatgacaacaatgcctccatgcaggcactaacaggatataacaataatgctcagtatatggcacaattagtgaatgcgatctatcaagcagatccgagtcttttgggtgtccaagacaaattcactttcgacaagagtgtgatccgttctgaagtactcaaatcgactggtgaaaaaccaggccgcgtcaatgtgaatggtcgagatgtcgatgtgagtggtcaaatggtaaccagcctttgggcaaaaaatggagctccaaccactcagtatcattttgcgattggaggttctgacagcgattatcagaacgcttgggcggctattctaggtaatgctggtggcaatcaaaacactaataaccgaaataataatacaaatagtagtgaaacaagcagtagttcaagtagtagcaattcaagcaataattctacaaatcgaaacagctcaaatcgtgacaatcggcgctag

SEQ ID NO: 2667 - DNA, 1929 bp, Unknown
  Artificiall/Consensus sequence
atgaaaaaatggttgttaaaactctcattggtagcgatgacactcttactcctaccaattcaagctgttcaagcctgttgtggttttatcattggtcgccaattgaccaaggatgggaccactctctttggtcggacagaagactacccttactatccaaatggtggaaagcacaacaaaaactttgtggttgttgatgcgaagaactataaggaaggggatcaactggaagacgaatccaatggttttacctatccacatgctgctagtgaaatgaaatacacagcgacttatgactctgctcgtggagatggtagtaacggtgcctttggtgaacacggatttaacgaagccggcgtctctatgacatcaactgttacagcaattccaaacaaaaaagtcttgaagaccgacccattgacagaaaacggaattccagaagctgctatgttggacgtggttttaccgcgcgttaagtctgctcgtgaaggggttgaattcctagctaaagtcattgaagaaaaaggatcagcagaagggaatgttgtcgtttttgcagaccaaaaagaaacttggtatatggaaattctttctggtcaccaatatgtagctgttaaagtcccagaagacaaatacgcagtctttgcaaatacctattaccttggtcatgtggatttaaatgacaaggaaaatgtgattgcttcgaaagatgtcgaaaaagtagccaaagaatctggtaactacaagacagacaaagatggcaacttccatattgcaaaatcttatggaccagataaatatgctgaaggggaccgttcacgtacttatgcaggaatcacccttttggatccaaaatcgaaagtgacctatgaagatgatgagtatgaactcttccgctcaccaacagatcctaacaagaaatttactttggaagatgcttttgctttccaacggaaccgttttgaacatttgaatggtcgttttgtaccagatgatcaaattggtgtcaagaaacaaggagacaatggtagtaacgatactgttcggaaagaccaatacaagtatgctttaggaaatgaaaacgtcatcgatgcccatgtctaccaaatcaatccaaaccttccaaaatcatttggtggtactttatggcttggtatgggaccatctcggaacactccgtatgttccattctatggaaatgtaaaagatacctataaggcttttaaacctcaaactgctacctatgatccgaattcatggtattggacagtatggcatattgacaacatggcgatcaataatcaagatatctttggtaaaactgttcaagatcactggaaagcattggaaaaacaattgattattgaacaagaagctagtgatgcgaaatataaagctctgaaagacaatccagaagctgctaaagcagtagaagatgaagttacagcaaatgctcttgcactatctaagaagatgtttgaacacttcaaatcttatgaagcagacatgcatgctcgtttagttgaagctggacgcaaggatgacccatatcgtgcatcattgccagataattacaaagatccagaaaatcctgtgacaccagaaaaaccggatcctggaacaaaaccagaagtgaatccaaacaatccggtagtagaacctaaaaaaccacttccaattcaaacaaaagtcaatgcggaaggcaatccaaataaccgctttggttatgcagctacaaaagataaggaatcttatgtttctacaagagttgaaacatttgtgaaacctgaagaaaaggttcaagatccatctgaagctgtatctgcaggtaatggtggcaatgaaaataatcgttttggttcttcttatgatgtagcaagtgctggtacattccaaaatacaaactactcatataatgtacatccttaa

SEQ ID NO: 2668 - DNA, 2463 bp, Unknown
  Artificiall/Consensus sequence
atgacaagacagaaacggaaatatgccattgtggatctggaagcgaccagtgctggaagtaatgcaaagatcattcaggttgggattgtcatcatcgaagatggaaggattacgcaatcctatgagacggatgtgaatccccatgagcgattggatgagcatatcaaacaattgactggcctgacagatgctcgcttacgaaaagctccagagtttgcacaagtggcaaaagaaatttttgaattaatagaagatgccgtctttgtggcccataatgtcaaatttgatgcgaatttattggcagaggccctcttttgggaaggattcgaactaacgactcctcgaattgatacggttgaattgtctcaaattttctatccgactttagaacgctacaatttaggagctcttgcggctgagttggaaattgagttgcatcatgctcactctgctctagcggatgctatggcaacagcccagctgctgttgaaattgagagaaaaaattgcgagcttaccaagaggattgatcgaaaaacttctttcgatggcagattgtttgatatatgaatcacgactcttaatagaagatgcgtttgaagacagtagtctttttttaccagttcatttagtagaagttcatggactctacctgcgaaagccacagcagttcttagaaagtcgtcagttgtctaaacagtttgaactcaatatgcagctgttgggaatggaagcttatccagagcagagagaatttgttgcctttatcgaggacagtttgcaccagccgcttccaagttttatcgaggcgccaacgggtactgggaagacctacgcctatctattaacgcttttggctaaaacctccaagcgcattcttgttagtgttccgactaaaattcttcaggatcaaattatgaagaaagaaggaaagactatccaagatcttttccaaattccctttcatagcctgaaaagtcccaaggattacatccaactcgataaattttatgaagccttacagagtgagtcagataatgggatgattcgacgttttaaaatgcaactcttggtttggctgacgatgacagaaacaggagagttcagtgaaattggccaactctatcgtcatcttcattttgtttctgagatatgccacgatggccaattgtcgaagcgttcccttttttatcaggaagatttttggcgtctcggccaggaaaaagtgaaaaccagccgggtgattctgaccaatcatgcctatctgttaacccgtctagaagatgataagagtctacttcaagaatctgttctggtagtggatgaagcgcaaaaactcttctttgctttagagcaattttcacaaagagaagaaaacttgcaaactcttcttctaagcttgcaacacgtcatcgaagaggagaaagatcttctgcagcgacgtttgctggagagtattcaatttgaactaaatgcctgctcaaaagaagtcctacaaggaaaagcagcgatcttatcagatcaaacggtggcaaaaattcgacaggatgtatcggaattaaaaaacgaatctctagagaatctaagggaattgtttgatgagcgctaccaaaccttttggatggacaaagaagtggttgaaagccaccagattcttcgtctccatggtggagttgaggacttactatcctttaaggagtttgtgcctgaagaggtgcccgtgctctttgtatcagcgacgatcgctattagtaaaaaagtgcatttacctgctcttttaggataccaagagcagcaaatctaccgggtgccaataacagtcaaacaacaccaggaattgttggtgccgatagatttcccagatgtcgtttctttatcttccgtagagtatgcaggagagatttgtcagctcatcgatgaacttcttcctctaagaaaaccaatttttcttttgtttacctcaaaagaattgttactggagacgtcaaacgcattgaagtttcctcatttggcccagtatcgaaatggagatgcagctaatattaagcgacgatttgacagaggagaaagctctattttattgggaacaggaagcttctgggagggagtcgatttttcccaacaaaaagaagtgattcaaatcatcacgcgccttccttttgataaccccaaagattacatggttcaaaaactgaatacccaactcagagaacaggggaaaaaccccttttatgactatagccttccggtcgcgattttaagattaaaacaggctattgggagaaccagccgttttcaagaccaggaatctttggtcctcttattggaccagcgggtggtgaccaaacgatatggaaaacaaattttagatgggctgaaacaagttttgcctcttcagacaactctgaggggcaagctggtggatcaagcccggcacttttttgaaaggaatacagaaaaatga

SEQ ID NO: 2669 - DNA, 1734 bp, Unknown
  Artificiall/Consensus sequence
ttgttcaattgtaatcataaaactattgtaaacctaaagtccctattttacaagtgtcatggaaaagtttataatgaagagaagaagaaacgaaagaggacaccaatgagtcacgaacaaaatgaccagcaagcccagatgcttcgcgggactgcctggatgacagccagcaactttatcagccgtttgctaggagctgcttatattattccttggtatatttggatgggcaaatatgggccacaagccaatggtctttttacaatgggctacaatatctatgcttggtttctcttgatttcgacagccggagtacccgtagctgttgccaagcaagtagccaaatacaatacccgggaccaagccgatcatagttttgctttgattcggggcttcttgaaattcatgggaattctaggccttggatttgccattctcatgtatcttttatctcctgtctttgctagcctttcaggtggggggaaagagttgattccgatcatgcagagcctttcttgggctgtcttgatctttccttcgatgagtgtcattcggggatttttccaaggttttaacaacatgaagccttacgctataagccagattgcagaacaagtcattcgggtcatctggatgttgctcacgaccttcttcattatgaagattggctctggagattatgtgcaagctgttacgcagtcaacctttgctgcctttatcggaatggtagcaagcttgttggttctcttttactaccttgcaaagacaggcttgctctcatctatttttaaaaaacaagaggaaagtgaagaaattgatacccgggcactcttgatcgatactatacgggaagccattccttttatcattactggttccgcgatccagctcttccaaattgtcgaccagatgacctttattaatattatgtcctggttcacagattatagtcagaaacagctcttggtcatgtttagttatttctctgctaatccaaacaaaattactatgatcttgatcgcagtagcgacttcgattgggggagtcggaattcctcttttgacagagaattacgtgaagggtgacctaaaagctgctgggaagctcgtacaggataacttgaccatgttattggctttcttgcttccagcgacctttggtgcagttgcggtcgcaaaaccactttatacggttttctatgggcaaccagatagcttagcattgggactcttcattgtagcgatgttgcagaccattattttaggtctttatatggtcttgtctccaatgattcaagccctctttcaaaaccgcaaggctattcgctatttcttttatggtgtagtggtgaaattggtcctacaaattccatttattttggtctttcgttcttatggaccacttttgtcaacgaccattgcgttaatggtgccaattgttctcatgtatcgagagatccaaaccatcactcagtttaatcgaaccatcgtctttaagcgcaccttacttggttctattctgaccgtggtgatgctacttggagtcttgattgcaggcttgattttgggctggattttcccaccaaatggtcgtgtatcgagcatgatttatatcatcgtcattggcggattaggagttgctatttatggagccttaggattatggctacgatattttgaccgctttatcggaggtcaagccacacgtctcagacaaaaattccgaatgaaataa

SEQ ID NO: 2670 - DNA, 1251 bp, Unknown
  Artificiall/Consensus sequence
atgaaaacaccttttgtaacccgtgaacaattagaaagtctgacccaagaattccctacccctttccatctctatgatgaagcaggaattcgtgaaacggctcgtgccctccatcaagcttttgcttggaatgaaggatttaaggaatactttgccattaaggcgactcctaatccatcgatcctaaaaattttgcaagaagagggctgtggagtcgacactgccagctatgtggaattgttaatggcggataaactaggctttagtggaaaagaaatcatgttttcttctaacaacacgccagctgatgaatttgtctatgctagagaattaggggcaactatcaatctggatgcctatgaagacattgctttcttgaagtctgtgactagcatccccaaggtcatttcttgccgctataatcctggtggagtttttgaactgggaaccgatattatggacaatcctgaagaagctaagtttggcatgaccaaggagcaattgatccaagcctttatcgagttgaaagaactaggtgtggaagagtttgggattcacgctttattggcttctaatacagtatccaacgactactatccagagctagcgcgtcaactttttgaattggcagtagaagtcgtcgagaaaacaggtgtctacttgggcttcatcaacctttctggtggagttggggtcaattacaaaccagaacaagaaccaaatgatattgccattattggggagggcgtgcatcgtgtttttgatgaaattctcaaaccggcaggacttggtcatgtgaaaatctataccgagcttggtcgctttatgctggcttcacacggcctcttggtaaccagagtgacgcataaaaagaaaacttaccggacttatgtcggggttgatgcttcagctgtgaaccttcttagaccggctatgtacggtgcttatcaccatattaccaatatggatcgtccagagggaatgactgaagtggtcgatgtcgtgggaagtctctgtgaaaataacgataaatttgctaaacaacgagaactacccgtgacggagattggagatttgctcgtgatccatgacactggagcccatggattttcaatggggtatcagtacaatgccaagttgcgttctgcagaagttctgcttcaagaagatgggcaggcccgtttgattcgtcgagcagaaaaaccagaagattatcttgcgacactctacggctttgacattgaaaaataa

SEQ ID NO: 2671 - DNA, 852 bp, Unknown
  Artificiall/Consensus sequence
ttgacgaaaatcgttaaaattagtaaaatagattggaaactttttacggaggaaaagatggactcgaatgaaaaagagctaagcctcaccccgattcctgggaagagtgggaaggcctacatggggacttacccagatggcgggcgcgtttttgtaaaaatgaatacgaccccaatccttgcgggtctagcaaaagaacagattgctcctcaattgttatggagtcgccgcttgccggatggaaatgtgatgagtgcccaagaatggttgaatggggaaattctaactccaaatggaatgtcgaaaaagcaagtggtcaatattttaacgagattgcaccgatctagacctttgatgacccaattaaagaaacttggttatccggtggaatctccgttagagttgctcaattcttggagtaaccggttgccaattgccctacgtcagaatcactatatccaatcagtcgtaaagaatttacgtaagacagtgcctgcctttcgggaggattatgcgacgatcgtccatggagatgttcgtcatagcaactggattgagacagagagtggcttgatttatctagttgattgggactctgttcgtttgacagaccggatgttggatgtggcgcatatattgagtcactatatcccagattctaattggcgcgattggttaggctattatggttacaaatacaatcaaaaagtatttgataaactctattggtttggtcaatactctttcttgtgtcaaattgctaaatactatgaaaataatgatttagaaaatgtcaatcgcgagatctatgctctgcgcaatttccggttgaaatatggaaaggaaatatga

SEQ ID NO: 2672 - DNA, 1242 bp, Unknown
  Artificiall/Consensus sequence
atgaaaattgataaaagacatcttttaaattattccatcctcattccctatttgattttatccatcattggtttgattgtagtctattcgacaacaagtgccttagcgattcaaagtggagtgagttcgatccggatggtgcggacgcaggggctcttttttatcctcagtctcttgaccattgcattgatctacaagtttagtttaaactttcttcgaaataagaaagttttagctgttattatctttattgaggtaattttgttacttctttcaaggtttgttactgatacggtcaatggggctcatggttggttgacaattcctggaggcttcagtatccagccagcggagtaccttaaggttattttagtctggtatttagctttaattttttctaaacggcaagatgaaatacgtgactatgattatcaagccttgacccataatgagtggattcctaggaatttaactgattggcgttggttgactttgattctcattggaatcgttgctattatgcccgacttaggaaatgcaaccatcttggctttaacggtcttgattatgattacggctagtggagtggggtaccgttggttcacttctctgcttggtttagtcgttagtggatcggcgattattcttggttcaatttggatcattggtgtggaccgtgtcgctaaaattcctgtttttggttatgtagccaaacgttttagtgccttcttcaatccatttaatgacttgactggtgcaggtcaccaattggccaattcctattatgccatgagtaacggtggatggtttggattaggcctaggaaattcaattgaaaagcaaggttatctacctgaagcacacactgactttgtatttgcgattgtgattgaagaattaggttttgttggagctagcttgatccttgcactcttattcttcttgattcttcgagtgatcttagtaggaattcgagcaaaaaatccttttaattctatgatggccattggtattggtggcatgatgttggtgcaaacctttattaacatcggaggaatttcgggtttgatcccatctactggggtaacttttcctttcttatcccaaggagggaacagcttatgggtcttatctgtagctattgcttttgttcttaatattgatgctagtgaaaaaagactaagaatgaagcaggaaggaatcctttttgaggagaagggtaaaattaaatcttattactaa

SEQ ID NO: 2673 - DNA, 1122 bp, Unknown
  Artificiall/Consensus sequence
atggaaacaaagtggaaagtgtttgctatgcttctcattggcttactatcgattggtttctttttctttagtaagggagcaaacggaatggatcaatcagaaacaagcacggagatgattaaaaaagcatcgatgagtcagactccagtagccaaaaaggaaacaaatgaaaaggttgatccaaaggatcagcgtgaaatttatttggctggtggttgcttctggggcgtagaggaatatttctcccgtgttccaggtgtgattgatgctgtgtcaggctatgccaatggaaagggagaaacgaccaagtatgaattagtccctcaaacaggccatgccgaaacagttcacatcacctacaatgtcaagaaggtgtctctgaaagaattgctcctgcattatttccggattatcggcccaacgtcgaagaatcgtcaaggaaatgatcaaggaactcaataccgaacaggtgtctattatgtctctcaagaagaccttccaaccattaaccaagtctttgaagaagaagcaaaaaaatacgacaaaccgttagtagtggaaaaagagccactgaccaatttcatcaaggctgaggactaccaccaggattatctaaagaaacatccgaatgggtactgccatatcgatgtcaatcaggcttcttatcctgttattgatgccagtcgctactccaagccaagcgatgaggagatcaaaaagaagttatctcctgaagagtatgcggtgacacaaaaaaatgataccgaacgggccttctccaatcgttactgggatcagtttgatgccggtatttatgtagatatcgtgactggtgagccgctcttttcctctaaggataaatttgattctggttgtggttggccaagtttcagtcggcctattagtcctgatgtggcgatttataaggaggataagagtttcaatatgactcggacagaagttcggagccgtgtgggaaattctcatctgggccatgtttttaccgatggtcccaaggaaaaaggcggccttcgctattgcatcaatagtttgtctattaccttcattcccaaagcagaaatgaaagaaaagggctacggttatttattggactatgtctga

SEQ ID NO: 2674 - DNA, 1968 bp, Unknown
  Artificiall/Consensus sequence
atgaaagcaaaaaaactgttagctcttgcaggagtttctgttgcaggtgcctttctcttagcagcgtgtggtggtggtagtagcaatcaagcaacctactcattcgtctattcagcggatccaaataccttggattacatcgctgcaactcgtacaacaacttcagatgtcacaagtaaccttgtagatggtcttcttgaaaacgaccaatacggaaactttgtgccaagtctagcagaagattggactgtctctgaagatggattaacctatacttacaaacttcgtaaggatgccaaatggtatacgagtgaaggagaagaatatggtgctgtaacggctcaagactttgttacagggatcaaacacgcggttgagtctaaatcagaaggtctcttcttgattcaaaattcgatcaaaggtttggatgcctatgtaaaaggggaaaccaaagactttaacacagttggagtcaaagccttagacgaccacaccatccaatatactttggtccgtccagaaagcttctggaactcaaaaacaacctcaggtgttcttttcccagtcaatgctgatttcttgaaatctcaaggaaaagattttggttctttgaaacctagcagcatcttatacaatggtccatattacttgaaatcattgacttcaaaatctgagattgaattggtcaagaacaaagactattacgatgcgaaaaatgttcatatcgataatgtcaaattgacctttaacgatggatcaaacccagattctatcattaaaaactttgaaaaaggtcaatattcctttgcatctgttatgccaaacagctcgacttacaagagcgttaagaaaaactttggcgacaacattgtctacggtttacaattaggaacatcctactatcttggattcaacttggaccgtcaaaagtatgaccacactgccaaaacaacggatgaacaaaaagcttctaccaagaaagcaatcctgaacaaggatttccgtcaagcggtaaactttgcatttgaccgtaaatcttatgcagcacaagtatccggggctgatgcggctgaaaatacccttcgtagtaccttggtgccaccaacctatgtccaaatcaatggagaagattttggtaaagtcgttgaaaaacaattggttacctatggagaccaatggaagggtgtgaatctggacgatggtcaaacaagcctttacagcccagaaaaagccaaggcttcatttgcgaaagctaaagctgaattgcaaaaacaaggagttcaattcccaattcatttggactatattgtcagccaagtggacaacagcatggtccaacaagctagctccttcaaacaatctgtagagtcagcgcttggtgcagacaatgtcgttgtggaccttcaaaaggtttcggatgatgatttccaaaatatcacctatttcagtgatacagcagctgcgagagattacgatatctcaggcggtggttgggcccctgactaccaagatccatccacttatctcgaaagtatcagcccagtcaatggttcagtttcatactattttggtatagatgcgggaacaaacaacccagccattgcagcagttggtttggaccaatacgccaacatgttaaaagatgcggatgctgaattgttggatcaagcaaaacgctacgaaaaatatgcagaagcacaagcttggttgacggatagtgcgattacgcttccaactgtttcaaatggtggttctccaatgcttcaacggaccgtaccatacagtcgtgctgcttcatgggttggtacaaaaggaacaggaacattctacaaataccttgaaatgtccaaagatgttgtcacaaccaaagactttaacaaggccaaagaagaatggttgaagaaaaaagcagaatccaataaaaaagctcaagaagatctcaaagatcacattgagaagaaaaaataa

SEQ ID NO: 2675 - DNA, 1485 bp, Unknown
  Artificiall/Consensus sequence
atgaaaaaacaagcttttagttctgaaaagtatttgaacttgcaacgtgaccacattattgagcggatcaaccaattcgatggcaagctctaccttgaatttggtggtaagatgttagaggacttccacgctgctcgtgtcctccctggatacgaaccagacaataagatcaagttactccaagaattgcgcgaccaggtggagattgtcattgccatcaatgccaacaatattgagcactcaaaagcccgtggagatctaggaatttcttatgaccaagaagtactgcgcttgatcgacaaattcaatgaactcggcatctatgttggatccgttgtcatcacccaatatgctggacaagctgcagcagacgcctttcgcaaacaactggacaagagcgggatcgcctcttatctccactatccgatcaagggctatccgactgatatggaccacatcatctctcctgaagggatggggaaaaatgactacatcaaaactagtcgcaatttggtcgttgtgacggctcctggacctggttctggtaagctggcaacttgtatgtccaatatgtaccatgaccaattaaatgggatcaaatccggttatgctaagtttgaaaccttccctgtatggaatcttcctttgcaccacccagtcaacttggcttatgaagcagcgactgcagatctagacgatgtcaatatgatcgatcctttccaccttcaaacctacggggaaacaacggtcaattacaaccgcgatatcgaaatcttccctgtcttgaagcgcatgttggaacgcatcttaggaacctcaccttatgcttctccaacagacatgggcgtcaacatggttggctttgccattgtggacaatgacgctgcgattgaagcttcccaacaagaaatcatccgtcgctattaccaaaccattttggatgttaaagcagagcgtgtcggtgaaggagctgtcaagaagatcgagctcttgatgaatgatttgggcattactccaaatgaccggaaagtgaccgttcttgctcgtcagaaagaagaagaaacaggggagccagccttggcccttgaattgccaaacggcgagatggtaaccggaaaaacctccgatctctttggcccaaccgcagccctcttgatcaatgcgattaagaaattggcgcatattgacaaagaaaccaaattaatcgagccagaatacgtgcagcctatccaaggcctgaagatcaatcatttgggcagccgtaaccctcgtcttcactcgaacgaaatcctcattgccctggccattacagccatgagcaacgaagatgctaagcttgctatgcaagaattaggcaagttgaaaggtagcgaagcccattcaaccgtgatgctgacagacgaagacaagaacgtccttcgcaagctcggtatcaacgttaccatggatcctgtctaccaatacgatcgcttgtatcgtaaataa

SEQ ID NO: 2676 - DNA, 1662 bp, Unknown
  Artificiall/Consensus sequence
gtgagtagtattaaattagtcactcttggcggtgttcgagaaaatgggaaaaatctctacgttgccgaagtgaacgattcgatttttgtcttggatgcaggtttgaagtatccagaaaatgagcaacttggggtggatgtcgttatccccaacatggattatctatttgaaaataaggaccgcattgcgggtgttttcttgacccatggtcatgcggatgccattggggccttgccttatcttttggcggaagcgaaggtccctgtattcgggacagagttgactattgagttggccaaactctttgtaaaaagcaatgacagtgtgaagaaattcaatgacttccatgtcatcgatcaaaattctgaaattgactttggagatgccgtcgtttccttcttccaaacaactcactccatccctgaaagtattgggattgtgattggtacttctgagggcaatatcgtctatacaggagactttaaatttgaccaaactgcaagtgagtcgtatgcaactgattttgcccgcctagctgaaattggacgtgagggtgtccttgcgctcttgagtgattcagccaatgcggatagtaagattcaagttgctagtgagcaagaagtgggcgatgagatcctggacaccattgcggactgggatggtcgtgtcatcgtggcggcggtagccagcaacctctcacggatccagcaggtctttgatgctgcggctgagactggccgtcgagtggtcttgacagggtttgatgtggaaaacatcgtccggacagctattcgcttgaacaaattgtctcttgccaacgaaaaactcttgatcaagccaaaagaaatgagccgttttgaagatcatgaattgatcattttggaaacaggccggatgggtgagccgatcaacggtttgcgcaagatgtctattggccgtcaccgctatgtggaaatcaaagatggggacttggtctacatcgttacaacaccatctattgctaaagaagctgtggtggctcgtgtggaaaacatggtctaccaagcaggtggcattgtcaaattgatcacgtcaagcttgcgtgtatctggtcacggaaacgcacgggacttgcagttgatgatcaaccttcttcgtcctaaatatctcttcccgatccaaggggaataccgcgaattggatgcccatgcgcgggtagcgatggaagtcggtatcttgcctgaaaatatctttattccaaaacgcggaactgtgatggagtacgaaaagggggactttgtccctgctggtagcgtctcagctggagatgtcatgatcgatgggaatgccattggtgatgtgggcaatattgtccttcgtgaccgcaaggtcttgtcagaagacgggatctttatcgtggcgatcacagtgaatcgcaaagagaagaaaattatttccaaagcgcgcgtgcacacccgtggttttgtctatgttaagaagagtcgggatattcttcgtgaaagttgcgaattggtcaaccaaagcgttgaagactatttggcacaagacagctttgactggggtgagttaaaaggtttggtacgcgacaacttgtctaagttcttgtttgaacaaaccaaacgccgtccagccatcctaccagttgtgatggaagtgaaataa
